United States Patent 12,569,549 (FLAVIVIRUS VACCINE) - sequence listing, part 10

SEQ ID NO: 6166 - RNA, 9879 nt, synthetic construct
  misc_feature 1..9879: note = derived and/or modified CDS sequence (wt) from DENV-1__EU482538__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctccgcaggtgtcaacatgtgcacccttatagcgatggatttgggagagttttgtgaggacacaatgacttacaagtgccctcgaatcactgaggcggaaccagatgacgttgattgctggtgcaatgccacagacacatgggtgacctatggaacatgttcccaaactggcgagcaccgacgagacaaacgttccgtcgcactggccccacacgtgggacttggtttggaaacaaggaccgaaacgtggatgtcctctgaaggcgcttggaaacagatacaaagagtggaaacttgggccctgagacacccaggattcacggtgatagccctttttctagcacatgccataggaacatccatcacccagaaagggattattttcattctgttaatgctggtaacaccatccatggcaatgcgatgtgtgggaataggtagcagggacttcgtggaaggactgtcaggagcaacttgggtagatgtggtactggaacatggaagttgcgtcaccaccatggcaaaagacaagccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacacaggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagccaaccccatagtcactgacagagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttccataggaggagtgttcacgtctgtcggaaaattagtacaccagatctttggaactgcatatggagtcttgttcagcggtgtttcctggaccatgaaaataggaataggagttctgctgacatggctaggattaaactcaaggagcacgtccctttcgatgacgtgcattgcagttggcctagtaacattatacctaggagtcatggttcaggcggattcaggatgtgtaattaattggaaaggtagagaactcaagtgtggaagtggcatttttgtcaccaatgaagttcacacttggacagagcaatacaaatttcaagctgactccccaaagagactatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaaaaaaatgattaggccacaacccatggaatacaaatactcgtggaaaagctggggaaaggctaaaatcataggggcagatgtgcagaataccaccttcatcatcgacggcccaaataccctagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattattgactgactttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgtcagtgccatagctcaaaccaaagcatcacaagaagggcctctaccagagattgaagacgaggtgtttaggaaaagaaacttaacaataatggacctacatccaggatcagggaaaacaagaagatatcttccagccatagtccgtgaggccataaaaaggaggctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattattatggatgaagcacatttcaccgatccatccagcatagcggccagagggtacatctcaacccgagtgggcatgggtgaggcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgacaatataaacacaccagaagggattatcccagccctcttcgagccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaatctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggttcgtggataggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattccactcatgaaatgtattgggtttcatgtggaacaggaaacattgtgtcagcagtaaacatgacatccagaatgttgctaaaccgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaacccatataaaacatgggcctaccatggatcatatgaggtcaagccgtcaggatcagcctcatccatggtcaatggcgtggtgaaactgctcaccaaaccatgggatgtcatccccatggtcacacaaatagccatgactgacaccacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaacgaggccaaaattactgacatcatggaacccgaacatgccctactggctaagtcaatcttcaagctaacataccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgagggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgctacagccttaactgctctgaatgatatgggaaaagttagaaaagatataccacaatgggaaccttcaaaaggatggaatgattggcaacaagtgcctttttgctcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatgtatccagttgggaagatgttccatatttaggaaaaagggaagatcaatggtgtggatccctgataggcttaacagcaagggccacctgggccaccaacatacaagtggccataaaccaagtgagaagactacttgggaatgagaattatctagattacatgacatcaatgaagagattcaagaatgagagtgatcctgaaggggcactctggtga

SEQ ID NO: 6167 - RNA, 9879 nt, synthetic construct
  misc_feature 1..9879: note = derived and/or modified CDS sequence (wt) from DENV-1__EU482539__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacattacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtggaattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcaacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagctccacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaacattccagggggaaacatgtatgcagatgacacagccggatgggatacaaggataacagaggatgaccttcagaatgaggccagaattactgacatcatggaacctgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6168 - RNA, 9879 nt, synthetic construct
  misc_feature 1..9879: note = derived and/or modified CDS sequence (wt) from DENV-1__KP188539__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagccaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaatcataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatacgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagccaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacgctgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaagggaaaaaaatgattagaccacaacccatggaacacaaatactcatggaaaagttggggaaaagctaagatcataggagcagacatacagaacaccacctttatcattgacggcccagacactccagaatgtcccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatgggttactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggttgcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaagatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcggtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccatacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcacccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctatgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggcccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagatggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaagtgacctaatattggaaataggaaaacttccacaacatttgacgctaagagcccagaatgctctggacaacttggtcatgttgcacaattccgaacaaggaggaaaagcctacagacatgccatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccacattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggcgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacacaagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaccaaaaaacccagaatctgcacaagagaggagttcacaagaaaagttaggtcaaacgcagcaataggagcagtgtttgttgatgaaaaccaatggaactcagcaaaagaagctgtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgcgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaacatacaagtagccataaaccaagtgagaaggctcatcgggaatgagaattatctagattatatgacatcaatgaagagattcaagaatgagagtgatcccgaaggggcactctggtaa

SEQ ID NO: 6169 - RNA, 9879 nt, synthetic construct
  misc_feature 1..9879: note = derived and/or modified CDS sequence (wt) from DENV-1__KP188540__SS-prME
  source 1..9879: mol_type = other RNA
tccgtgaccatgctcctcatgctgctgcccacagccctggcgtttcatttgaccacacgagggggagagccacacatgatagttagtaagcaagaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagtttaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacgatgaaagaaaaatcatggcttgtccacaaacaatggtttctagacttaccactgccatggacttcgggggcttcaacatctcaagagacctggaacagacaagatttgctggtcacattcaagacagctcacgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagctggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatgctatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctatgtcagtgccattgcccaagctaaagcatcacaggaagggcctctaccagagattgagaacgaggtgttcaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagaggatacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgttattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagccaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggatgtggagatctggacaaaggaaggagaaagaaagaaattgcgacctcgctggttggacgccagaacatactctgatccattggccctgcgcgagttcaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacactatagaaacattgatgcttctagctttgatagctgtgttgactggtggagcgacgctattcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctactcatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagtcgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtggccataaaccaagtgagaaggctcatcgggaatgagaattatttagattacatgacatcaatgaagagattcaagaatgagagtgatcccgaaggagcactctggtaa

SEQ ID NO: 6170 - RNA, 9879 nt, synthetic construct
  misc_feature 1..9879: note = derived and/or modified CDS sequence (wt) from DENV-1__KP188541__SS-prME
  source 1..9879: mol_type = other RNA
tccgtgaccatgctcctcatgctgctgcccacagccctggcgtttcatttgaccacacgagggggagagccacacatgatagttagtaagcaagaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggcaatggctgtggactattcggaaagggaagtctattgacgtgtgccaagtttaagtgtgtgacaaaattagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacactggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaagatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagctggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattgagcctggtggcatccgtggagctaccaaattctctggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgttttttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcctgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggggaaaatagtgggtctgtatggaaatggagtggtgacaacaagtggaacctatgtcagtgccattgcccaagctaaagcatcacaggaagggcctctaccagagattgagaacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacatttcaccgatccagctagcatagcggctagaggatacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcgaatttccgggccgacagggtaatagacccaaggcggtgcttgaaaccggtaatactaaaagatggtccagagcgtgttattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagccaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagttcaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctgtggaggaactaccagacaccatagaaacattgatgcttctagctttgatagctgtgttgactggtggagtgacgctattcttcctatcaggaaaaggtctagggaaaacatccattggcttgctctgtgtgacggcctcaagcgcactgttatggatggccagtgtggagccccattggatagcggcctccatcatactggagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattctcaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatatacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagtcgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacttagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtggccataaatcaagtgagaaggctcatcgggaatgagaattatttagattacatgacatcaatgaagagattcaagaatgagagtgatcccgaaggagcactctggtaa

SEQ ID NO: 6171 - RNA, 9879 nt, synthetic construct
  misc_feature 1..9879: note = derived and/or modified CDS sequence (wt) from DENV-1__KP188543__SS-prME
  source 1..9879: mol_type = other RNA
tccgtgaccatgctcctcatgctgctgcccacagccctggcctttcatttgactacacgagggggagagccacatatgatagtcagcaagcaggaaagaggaaagtcactcttgtttaagacctctgtaggtgtcaacatgtgcactctcattgcgatggatttgggagagttatgtgaggacacaatgacctataaatgcccccggatcactgaggtggaaccagatgatgttgactgctggtgcaatgccacagacacatgggtgacctatgggacgtgttctcaaaccggcgaacaccgacgagacaaacgttccgtcgcactggccccacacgtgggacttggtttagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgcgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcaggagcttcaacatcccaagagacttggaacagacaagatttgctggtcacattcaagacagctcatgcaaagaaacaggaagtagtcgtgctgggatcacaggaaggagcaatgcacaccgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaaccgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtccgtgggaaaattgatacaccaggtttttggaactgcatatggggttctgttcagcggtgtctcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattggaaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgtcaatggaattttggcccaaggaaaaaaaatgattagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcttttatagaagtcaagacatgcatctggccgaaatcccacactctatggagtaatggagttttggaaagtgaaatggtaatcccaaagatatatggaggaccaatatctcagcataactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaaatggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggactaagcctggtggcatccgtagagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggccatggcactgtcaatcgtatctctctttcctttgtgtctgtctacgacctcccaaaaaacaacatggcttccggtgctgttaggatcttttggatgtaaaccattaaccatgtttctcataacggaaaacaaaatttggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagttcagctgatttatcattggaaaaagcggctgaggtatcctgggaagaagaagcagaacactccggcacctcacacaacatattagtggaggtccaagatgatggaaccatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtattccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaactacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcattaaatcaggaaatgacatagctaactgtttaagaaagaacggaaaacgggtgattcaactgagcaggaaaacctttgacactgagtaccagaaaacaaaaaacaatgactgggactacgttgtcacaacagacatctccgaaatgggagcaaatttccgggccgacagggtaatagatccaaggcggtgcttgaaaccggtaatactaaaggaaggtccagagcgcgttatcctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgatagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagttcgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacactgttcttcctatcaggaaaaggtctagggaaaacatccattggcctactttgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcgtagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattgggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaactggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtgtcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaaaacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 6172 - RNA, 9879 nt, synthetic construct
  misc_feature 1..9879: note = derived and/or modified CDS sequence (wt) from DENV-1__KP188544__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgctctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggttctataggaggattgttcacgtctgtgggaaaattgatacaccaggtttttgggactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaagggaaaaaaatgattagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaactggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatattgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatgcagagaagttcttcttctcacggtcggattaagcctggtggcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggagagggcagttcttgatgatggcatttatagaatcttgcaaagaggactgttgggtaggtcccaagtaggagtgggagttttccaagacggcgtgttccacacaatgtggcacgtcaccaggggagctgtccttatgcaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttgagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcttccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctagggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaagtctttaggaggaggtaggagaggaacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatattattggccagaggatagagaacataaaaaatgaacataagtcaacatggcatcatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggcttatcgggaatgagaattatctagattatatgacatcaatgaagagattcaagaatgagagtgatcccgaaggggcactctggtaa

SEQ ID NO: 6173 - RNA, 9879 nt, synthetic construct
  misc_feature 1..9879: note = derived and/or modified CDS sequence (wt) from DENV-1__KP188547__SS-prME
  source 1..9879: mol_type = other RNA
tccgtgaccatgctcctcatgctgctacccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcatcttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccatcctgcgcaaactgtgcattgaagctaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacgtgtgctaagttcaagtgtgtgacaaaactcgaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagacgcaccatgcaagatcccttttctgacccaagatgaaaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtctgtgggaaaattgatacatcaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtgggagacgttaatggaattttggcccaaggaaaaaaaatgattaaaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatccctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtgatgagatctagatggagtagaaagatgctgatgactggaacactggctgttttcctccttctcataatgggacaactgacatggaatgatctgatcaggttatgcatcatggttggagccaatgctttagacaggatggggatggggacaacgtacctagccttgatggccactttcaaaatgagaccaatgttcgctgttgggctattgtttcgcagactaacatccagagaagttcttcttctcacggttggattaagcctggtggcatccgtggagctaccaagctctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgcttgcagtctcaggagtgtacccaatgtcaataccggcaactctttttgtgtggtatttttggcagaaaaagaaacagagatcaggagtgctatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatcgctcaagctaaagcaacacaagaagggactctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccgataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgattttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttgaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaacaaccaggtgttggaggagaacatggacgtggagatctggacaaaggaaggagaaagaaagaaattgcgaccccgctggctggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgttgttcttcctatcaggaaaaggtctagggaaaacatccattggcctactctgtgtgatggcctcaagcgcactgttatggatggccagtgtggagccccattggatagcggcttccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggccaaataatgttactgatactttgtacatcacagattctcttgatgcggaccacatgggccttgtgtgaatccatcacactggccactggacccttgactactctttgggagggatctccaggaaaattctggaacaccacgatagcagtgtccatggcaaacatcttcaggggaagttatctagcaggagcaggtctggccttctcgttgatgaaatctttaggaggaggtaggagaggtacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctggactgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaattctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccttacaaaacatgggcctatcatggatcatatgaggtcaaaccatcaggatcagcctcatccatggtgaatggcgtggtgagattgctcactaaaccatgggatgtcatccccatggtcacacaaatagctatgactgataccacaccctttggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagtcaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaacgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctaggaaaaagggaagatcaatggtgtggatccttgataggtttgacagcaagggccacctgggccactaatatacaagtagctataaaccaagtgagaaggctcatcgggaatgagaattatctagactatatgacatcaatgaagagattcaagaatgagagtgatcccgaaggggcactctggtaa

SEQ ID NO: 6174 - RNA, 9879 nt, synthetic construct
  misc_feature 1..9879: note = derived and/or modified CDS sequence (wt) from DENV-1__KP723473__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggctacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagttcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagagggagaaagaaagaaatgcgactcgcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaatccagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggacagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtgtggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6175 - RNA, 9879 nt, synthetic construct
  misc_feature 1..9879: note = derived and/or modified CDS sequence (wt) from DENV-1__KT187564__SS-prME
  source 1..9879: mol_type = other RNA
tctgtgaccatgctccttatgctgatgcccacagccttggcgttccatttgactacacgagggggagagccgcacatgatggttagcaagcaggaaagaggaaagtcacttctgtttaagacctcagcaggtgtcaacatgtgcacccttatagcgatggatttgggagagttatgtgaggacacaatgacttacaaatgccctcgaatcactgaggcggaaccagatgatgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggatttacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaattttgtgtgtcgacgaacgtttgtggatagaggctggggcaatggctgtgggctcttcggaaaaggaagccttataacgtgtgctaagttcaagtgtgtgacaaaattggaaggaaaaatagttcaatatgaaaacttgaaatattcagtaattgtcaccgtccacactggagaccagcaccaagtgggaaatgaaagcacagaacatgggacaactgcaactataacacctcaagctcccacgacggaaatacagctgaccgactacggagctcttacactggattgttcacctagaacaggactagactttaatgaaatggtgttgttgacaatgaaaggaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacatttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaactcagaatgggagattaataacagccaaccccatagttactgacaaagaaaagccagtcaacattgaggcggaaccgccttttggtgagagttacattgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggggttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttactcgaaaatgacatgaaattcacagtggttgtaggagatgttgctgggatcttggctcaggggaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccaccggcttatgtcagctgccatcaaggacagcaaggcagttcacgctgacatggggtactggatagaaagtgaaaagaacgagacctggaagctggcaagagcctctttcatagaagtcaaaacatgtatttggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgagggccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactgggactgctatgcatatcaataatgatcgaagaggtgatgagatccagatggagtagaaaaatgctgatgattggaacattggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaatcggattgagtctagtggcatctgcggagttaccaaattccttggaggagctgggggacggacttgcaatgggcattatgattttaaaattattgactgactttcaatcacatcagctgtgggctactttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagttcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgttcccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccttaccagagattgaagacgaggtgtttaggaaaagaaacttaacaataatggacctacatccaggatcggggaaaacaagaagataccttccagccatagtccgtgaggccataaaaaggaaactgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataatgactgggactatgtcgtcacaacagacatctccgaaatgggagcaaatttccgggccgacagggtgatagacccaagacggtgtctgaaaccggtaatactaaaagatggtccagagcgcgtcatcttagcaggaccgatgccagtgactgtggccagtgctgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggatgtggagatctggacaaaagaaggagaaagaaagaagctacgaccccgctggctggatgccagaacatactcagacccactggctttgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggattggccatgtggctgttgaaaaccaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgctgatactatgcacatcacagatcctcttgatgcggactacatgggccttgtgcgaatccatcacgttggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacgactgaaccaactgagcaagtcagaatttaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatattattgcgctgggctgaagaaagtcacagaagtgaagggatatacaaaaggaggacctggacatgaagaaccaatcccaatggcgacctatggatggaacctagtaaagctgcattccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacacgtggcagtggaaccagaggtagccaacctagatatcattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaggagaaagttgatacacgcacaccaaaagcaaaacgaggcacagcacaaatcatggaggtgacagccaggtggttatggggttttctttctaggaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagagagcttcacaaacagggaaaatgtgccacgtgtgtttataacatgatggggaagagagagaaaaagttaggagagtttggaaaggcaaaaggaagtcgtgcaatatggtacatgtggttgggagcacgctttctagagttcgaagctcttggattcatgaacgaagaccactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaatgaggccaaaattactgacattatggaacccgaacatgccctactggctaaggcaatcttcaagctaacctaccaaaataaagtggtgagggtacagagaccagcaaaaaatggaaccgtgatggatgtcatatccagacgtgaccagagaggaagtggccaggtcggaacttatggcttaaacactttcaccaacatggaagcccagttgataagacaaatggagtctgagggaatcttttcacccagtgaattagagaccccaaatttagccgagagagttctagactggctgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctgggtggagcctgagagaaaccgcatgcctaggcaaatcatatgcacaaatgtggcagctgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccaattgggaagatgttccatatttagggaaaagggaagatcaatggtgtggatccctgataggcttaacagcaagggccacctgggccaccaacatacaagtggccataaaccaagtgagaagactaattgggaatgagaattatctggattacatgacatcaatgaagagattcaagaacgagagtgatcccgaaggggcactctggtga

SEQ ID NO: 6176 - RNA, 9879 nt, synthetic construct
  misc_feature 1..9879: note = derived and/or modified CDS sequence (wt) from DENV-1__KT187560__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagatacatgggtgacctatgggacgtgttctcagactggcgaacaccgacgggataaacgttctgtcgcattggctccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcccttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagtcacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttacttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6177 - RNA, 9879 nt, synthetic construct
  misc_feature 1..9879: note = derived and/or modified CDS sequence (wt) from DENV-1__KT187561__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccttttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtaaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggctctgcgcgagtttaaggagttcgcagctggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcctgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6178 - RNA, 9879 nt, synthetic construct
  misc_feature 1..9879: note = derived and/or modified CDS sequence (wt) from DENV-1__KT187562__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactgaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaaactttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagacttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6179 - RNA, 9879 nt, synthetic construct
  misc_feature 1..9879: note = derived and/or modified CDS sequence (wt) from DENV-1__JQ045628__SS-prME
  source 1..9879: mol_type = other RNA
tctgtgaccatgctccttatgctgatgcccacagccttggcgttccatttgactacacgagggggagagccacacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccttttttctagcacatgccataggaacatccatcactcagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcccacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatctgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccgaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgattgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttctccttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccttgaaggtgaagttggagccattgccctagattttaaacccggcacatctggttctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactgattctggcccccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacatttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatagcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatcagaagccaaagagggattgaaaagaggagaaacaaccaaacatgcagtgtcgagaggaaccgctaaactgagatggtttgtggagcggaaccttgtgaaaccagaagggaaagtcatagacctcggttgtggaagaggtggctggtcatactattgcgctgggctgaagaaagttacagaagtgaagggatacacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggtcacacaaatagccatgactgacaccacaccctttggacaacagagggtgtttaaagagaaagttgacacacgcacaccaaaagcaaaaagaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttataacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgataggtttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaagaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6180 - RNA, 9879 nt, synthetic construct
  misc_feature 1..9879: note = derived and/or modified CDS sequence (wt) from DENV-1__JQ045629__SS-prME
  source 1..9879: mol_type = other RNA
tctgtgaccatgctccttatgctgatgcctacagccttggcgttccatttgactacacgagggggagagccgcacatgatggtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggatcattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcgggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccactttcatcatcgatggcccaaacaccccagaatgccctgatgaccaaagagcatggaacatttgggaagttgaggactatggatttggaattttcacgacaaacatatggctgaaattgcgcgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtttagtggcatctgtggagttaccaaattccctggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagctgaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctactcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaataccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagttgcactctgggaaagacgtgttctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaatcaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6181 - RNA, 9879 nt, synthetic construct
  misc_feature 1..9879: note = derived and/or modified CDS sequence (wt) from DENV-1__JQ045630__SS-prME
  source 1..9879: mol_type = other RNA
tctgtgaccatgctccttatgctgatgcccacagccttggcgttccatttgactacacgagggggagagccacacatgatagtcagcaagcaggaaagaggaaaatcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatctgctggtgacatttaagacagcccatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttccataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaatcaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcttctttcatagaagttaaaacatgtatctggccaaaatcccacactctatggagcaatggagttctggaaagtgaaatgataattccgaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgattgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattaggatcccttggatgcaaaccactaaccatgtttctcatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacaacgccgggcacttttaagacccctgaaggtgaagttggagccattgccctagattttaaacccggcacatctggatctcccatcgtgaacagagaaggaaaaatagtgggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggcccccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtttgtggagctcatgagaagaggagatctacctgtctggctatcttacaaagttgcctcagaaggcttccagtactctgacagaagatggtgctttgacggggaaaggaacaaccaggtgttggaggagaacatggacgtggagatctggacgaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacatttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatagcttcaagcgtactgctatggatggccagtgtggagccccattggatagcggcctccatcatactggagtttttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttggggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctacaaaaggagtgggattatggaagtggacagatcagaagccaaagagggattgaaaagaggagaaacaaccaaacatgcagtgtcgagaggaaccgctaaactgagatggtttgtggagcggaaccttgtgaaaccagaagggaaagtcattgacctcggttgtggaagaggtggctggtcatactattgcgctgggctgaagaaagttacagaagtgaagggatacacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggtcacacaaatagccatgactgacactacaccctttggacaacagagggtgtttaaagagaaagttgacacacgcacaccaaaagcaaaaagaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttataacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgattgcgtggtgaaaccaattgatgatagatttgcaacagccttaacagctctgaatgacatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaagaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6182 - RNA, 9879 nt, synthetic construct
  misc_feature 1..9879: note = derived and/or modified CDS sequence (wt) from DENV-1__JQ045632__SS-prME
  source 1..9879: mol_type = other RNA
tctgtaaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggatcattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacatttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagatctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatcccttttttgacccaagatgaaaaaggagtgacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctattggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcgggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgcgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaggaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccctggaggagctgggggatggacttgcaatgggcatcatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagagaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaatcccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaaaaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatttacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagagcccagaatgccttggacaacctggttatgttgcacaactccgaacaaggaggaagagcctatagacatgcaatggaagaactgccagacaccatagaaacgttgatcctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaagtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatttagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaagttctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6183 - RNA, 9879 nt, synthetic construct
  misc_feature 1..9879: note = derived and/or modified CDS sequence (wt) from DENV-1__JQ045633__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctggccgactacggagctcttacattggattgttcacctagaacaggactagacttcaatgaaatggtgttgttgacaatgaaagaaaaatcatggctagtccacaaacaatggtttttagacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaagggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcattttcgtcaccaatgaagttcacacttggacagagcaatacaaatttcaagctgactccccaaagagactatcagcagccatcgggaaggcatgggaggagggtgtgtgtggaatccgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggccaaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagtcgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcctccttctcataatgggacaattgacatggaacgatctgatcagattatgcatcatggttggggccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaactattctccttaaagcaactctgttagcagtttcaggggtgtacccactatcaataccagcaactcttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgttaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagtatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagcccttttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctaaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaatatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctatcaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccagtggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6184 - RNA, 9879 nt, synthetic construct
  misc_feature 1..9879: note = derived and/or modified CDS sequence (wt) from DENV-1__JQ045634__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctggccgactacggagctcttacattggattgttcacctagaacaggactagacttcaatgaaatggtgttgttgacaatgaaagaaaaatcatggctagtccacaaacaatggtttttagacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaagggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggagctgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcattttcgtcaccaatgaagttcacacttggacagagcaatacaaatttcaagctgactccccaaagagactatcagcagccatcgggaaggcatgggaggagggtgtgtgtggaatccgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggccaaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagtcgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcctccttctcataatgggacaattgacatggaacgatctgatcagattatgcatcatggttggggccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaactattctccttaaagcaactctgttagcagtttcaggggtgtacccactatcaataccagcaactcttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgttaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagtatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagcccttttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctaaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaatatgcagtgtcgagaggaaccgctaaactgaggtggtttgtggagaggaaccttgtgaaaccagaagggaaagtcatagacctcggttgtggaagaggtggctgggcatactattgcgctgggctgaagaaagtcacagaagtgaagggatatacaaaaggaggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggggaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctatcaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccagtggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6185 - RNA, 9879 nt, synthetic construct
  misc_feature 1..9879: note = derived and/or modified CDS sequence (wt) from DENV-1__JQ045636__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaacatgtgcaccctcatagcgatggatctgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgactaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacaactgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagcgacccagaatgggagactaataacagctaaccccatagtcactgacaaagaaaaaccagtcaacattgaagcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagattatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaagaaaatgattaggccacaacccatggagtacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacagcagggccgtggcacttaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccgacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattgttgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttctagatgatggtatctatagaattatgcagagaggactgttgggcaggtcccaagtaggggtaggagttttccaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggtacatctggatctcccatcgtgaacagagaaggaaaaatagtaggcctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggctgaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaacgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgacccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagaaccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttacgatgcaaaatttgagaaacaactaggccaaataatgttgttgatactatgcacatcacagatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactactcaccaaaccatgggatgtcatccctatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaagctaacataccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgaaggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagacttcttgggaatgagaattatctagattacatgacatcaatgaagagattcaagaatgagagtgatcctgaaggggcactctggtga

SEQ ID NO: 6186 - RNA, 9879 nt, synthetic construct
  misc_feature 1..9879: note = derived and/or modified CDS sequence (wt) from DENV-1__JQ045635__SS-prME
  source 1..9879: mol_type = other RNA
tctgtgaccatgctccttatgctgatgcctacagccctggcgttccatttgactacacgagggggagagccgcacatgatagtcagcaagcaggaaagaggaaagtcacttttgtttaagacctcagcaggtgtcaacatgtgcaccctcatagcgatggatctgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgttaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgtgactaaactggaaggaaagatagttcaatatgaaaacttgaaatattcagtaatagtcaccgtccacacaggagaccagcaccaggtgggaaatgaaagcacagaacatgggacaattgcaactataacacctcaagctccttcgacggaaatacaactgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagcgacccagaatgggagactaataacagctaaccccatagtcactgacaaagaaaaaccagtcaacattgaagcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggagttctgctgacatggctaggattaaactcaaggagcacgtccctttcgatgacgtgcattgcagttggcctagtaactttatacctaggagtcatggttcaggcggattcaggatgtgtaattaattggaaaggtagagaactcaaatgtggaagtggcatttttgtcactaatgaagttcacacttggacagagcaatacaaatttcaagctgactccccaaagagattatcagcagccatcgggaaggcatgggaggaaggtgtgtgtggaatacgatcagcaactcgtctcgagaacatcatgtggaagcaaatatcaaatgaactgaaccacatcttacttgaaaatgacatgaaactcacagtggttgtaggagatgttgctggaatcttggctcaagggaagaaaatgattaggccacaacccatggagtacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacagcagggccgtggcacttaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgcttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccgacgcttccgacaggatggggatgggaacgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattttgaaattgttgactgattttcaatcacatcagttgtgggctaccttgctgtccttgacatttatcagaacaacgttttccttgcactatgcatggaagacaatggccatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgtggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcaaccctttttgtgtggtacttttggcagaaaaagaaacagagatctggagtgttatgggacacacctagccctccagaagtggaaagagcagttctagatgatggtatctatagaattatgcagagaggactgttgggcaggtcccaagtaggggtaggagttttccaagaaaacgtgttccacacaatgtggcatgtcaccaggggagctgttctcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaacccaaaaaatgtacaaacagcgccgggcaccttcaagacctctgaaggtgaagttggagccattgccctagattttaaacccggtacatctggatctcccatcgtgaacagagaaggaaaaatagtaggcctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggctgaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtatatctcaacccgagtgggcatgggtgaggcagctgcgatcttcatgacagccactcctccaggatcagtggaggcctttccacagagcaacgcagtcatccaagatgaggaaagagacattcctgagagatcatggaactcaggctatgagtggatcactgacttcccaggtaaaacagtttggtttgttccaagcatcaaatcaggaaacgacattgccaactgcttaagaaagaatgggaaacgggtgattcagttgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcatgctcactggacagaagcaaaaatgctccttgataatataaacacaccagaagggattatcccagccctcttcgacccggagagagaaaagagtgcagcaatagacggggaatatagactgcggggtgaagcaaggaaaacgtttgtggagcttatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagagcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagaaccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgacaaaggatggccaatatcgaagatggacataggagttccacttctcgccttggggtgctattcccaggtgaatccactgacgctgacagcggcggtgttgatgctagtggctcattacgccataattggacctggactgcaagctaaagctactagagaagctcaaaaaaggacagcggccggaataatgaaaaatccaaccgttgatggaattgttgcaatagatttggatcctgtggtttacgatgcaaaatttgagaaacaactaggccaaataatgttgttgatactatgcacatcacaaatcctcttgatgcggactacatgggccttgtgcgaatccatcacactagctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacttataaaaggagtgggatcatggaagtggacagatccgaagccaaagagggactgaaaagaggagaaacaaccaaacatgcagtgtcgagaggaacagctaaactgaggtggtttgtggagaggaatcttgtgaaaccagaagggaaagtcatagacctcggttgtggaagaggtggctgggcatactattgcgccgggctgaagaaagtcacagaagtgaagggatatacaaaaggaggacctggacatgaggagccaattccaatggcgacctatggatggaacctagtaaaactgcactccgggaaagacgtattcttcataccacccgagaaatgtgacacccttttgtgtgatattggtgagtcttctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctaccatggatcatatgaggtcaagccgtcaggatcagcctcatccatggtcaatggcgtggtgaaactactcaccaaaccatgggatgtcatccctatggtcacacaaatagccatgactgacactacaccctttggacaacagagggtgttcaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggctgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaacgaggccaaaattactgacatcatggaacccgaacatgccctactggctaagtcaatcttcaagctaacataccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgaaggaatcttttcacccagcgaattagagaccccaaatttagccgggagagttctcgactggctggaaaaacatggcgtcgaaaggctgaaaagaatggcaatcagcggagatgactgcgtagtgaaaccaattgatgataggtttgcaacagccttaacagctctgaatgacatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatacttaggaaaaagggaagatcaatggtgtggatccctgataggcttaacagcaagggccacctgggccaccaacatacaagtggccataaaccaagtgagaagacttcttgggaatgagaattatctagattacatgacatcaatgaagagattcaagaatgagagtgatcctgaaggggcactctggtga

SEQ ID NO: 6187 - RNA, 9879 nt, synthetic construct
  misc_feature 1..9879: note = derived and/or modified CDS sequence (wt) from DENV-1__JQ045637__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaatgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggactaaactcaaggagcacgtccctttcgatgacgtgtattgcagttggcctagtaacactatacctaggagtcatggttcaggcggattcaggatgtgtaataaattggaaaggtagagaactcaaatgtggaagtggcatttttgttaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaatcacatcttacttgaaaatgatatgaaattcacggtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaagtcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcctttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccgcttttaaaatgagaccaatgtttgctgtagggctattatttcgcagactaacatccagagaagttcttcttctaacaattggattgagtctagtggcatctgtggagttaccaaattccttggaggagctgggggatggacttgcaatgggcattatgattttaaaactattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatctcttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagcaggaggcatgctaatagcatgttatgttatatctggaagctcggccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcaaagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtttgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgagccagagagagaaaagagtgcagcaatagacggtgaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatagaagaactgccagacaccatagaaacgttgatgctcctagctttgatagctgtgttaactggtggagtgacactgttcttcctatcaggaaggggcttagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgtggaaaatcaccaccatgccgcaatgctggacgtagacctacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacatttttagaggaagttatctagcaggagcaggtctggccttctcattaatgaaatctctaggaggaggtaggagaggcacgggagctcaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagttgcactctgggaaagacgtattctttataccacctgagaaatgtgacacccttttgtgtgatattggtgagtcctctccaaacccaactatagaggaaggaagaacgctacgtgtcctaaagatggtggaaccatggctcagaggaaaccaattttgcataaaaatcttgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggattcatgaacgaagatcactggttcagcagagagaattcactcagcggagtggaaggagagggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggccagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6188 - RNA, 9879 nt, synthetic construct
  misc_feature 1..9879: note = derived and/or modified CDS sequence (wt) from DENV-1__JQ045638__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggttgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaatgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggactaaactcaaggagcacgtccctttcgatgacgtgtattgcagttggcctagtaacactatacctaggagtcatggttcaggcggattcaggatgtgtaataaattggaaaggtagagaactcaaatgtggaagtggcatttttgttaccaatgaagttcacacttggacagagcaatacaaatttcaagctgactccccaaagagactatcagcagccatcgggaaggcatgggaggaaggtgtgtgtggaattcgatcagcaactcgtctcgagaacatcatgtggaagcaaatatcaaatgaactgaatcacatcttacttgaaaatgatatgaaattcacggtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaagtcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcctttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccgcttttaaaatgagaccaatgtttgctgtagggctattatttcgcagactaacatccagagaagttcttcttctaacaattggattgagtctagtggcatctgtggagttaccaaattccttggaggagctgggggatggacttgcaatgggcattatgattttaaaactattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatctcttggatgcaaaccactaaccatgtttcttatagcagaaaacaaaatctggggaaggagaagttggcctctcaatgaaggaatcatggctgttggaatagtcagcatcctactaagttcactcctcaaaaatgatgtaccgctagctgggccactaatagcaggaggcatgctaatagcatgttatgttatatctggaagctcggccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcaaagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatttcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagccgacagggtgatagacccaagacggtgtttgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgagccagagagagaaaagagtgcagcaatagacggtgaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatagaagaactgccagacaccatagaaacgttgatgctcctagctttgatagctgtgttaactggtggagtgacactgttcttcctatcaggaaggggcttagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgtggaaaatcaccaccatgccgcaatgctggacgtagacctacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacatttttagaggaagttatctagcaggagcaggtctggccttctcattaatgaaatctctaggaggaggtaggagaggcacgggagctcaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctgggcatactattgcgctgggctgaagaaagtcacagaagtgaagggatatacaaaaggaggacctggacatgaggaaccaatcccaatggcgacctatggatggaacctagtaaagttgcactctgggaaagacgtattctttataccacctgagaaatgtgacacccttttgtgtgatattggtgagtcctctccaaacccaactatagaggaaggaagaacgctacgtgtcctaaagatggtggaaccatggctcagaggaaaccaattttgcataaaaatcttgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggattcatgaacgaagatcactggttcagcagagagaattcactcagcggagtggaaggagagggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggccagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6189 - RNA, 9879 nt, synthetic construct
  misc_feature 1..9879: note = derived and/or modified CDS sequence (wt) from DENV-1__JQ045639__SS-prME
  source 1..9879: mol_type = other RNA
tctgtgaccatgttccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaaatgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgactgactacggagctctaacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttttagtgcagattaaatacgaaggaacagatgcaccatgcaagatccctttttcgacccaagatgaaaaaggagtgacccagaatgggagattgataacagctaaccccatagttactgacaaagaaaaaccagttaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaactagtacaccagatctttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgacttgtgtgagggtaccacagttgttgtggatgaacattgtggaaatcgaggaccatctcttaggaccacaacagtcacaggaaagataattcatgaatggtgttgcagatcttgcacgttaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagctgacctatcattagagaaagcggctgaggtctcctgggaagaagaagcagaacactctggtgcctcacacaatatattagtggaagtccaagatgatggaaccatgaagataaaggatgaagagagagatgacacgctaaccattctccttaaagcaactctgttagcagtttcaggggtgtacccattatcaataccagcgacccttttcgtgtggcacttttggcagaaaaagaaacagagatctggagtgttatgggacacacccagccctccagaagtggaaagagcagttcttgatgatggtatctacagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccagagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccaccttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgcactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgcggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaatcgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagaaaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaaaggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgagagagacgtggacctaggcgccggaacaagacatgtggcagtggaaccagaggtggccaacctagatatcattggccagaggatagagaacataaaacatgaacataagtcaacatggcactatgatgaggacaatccatataaaacatgggcctaccatggatcgtatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacggcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaagatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggggaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatctatgaagagattcaagaacgagagtgatcccgaaggggcactctggtga

SEQ ID NO: 6190 - RNA, 9879 nt, synthetic construct
  misc_feature 1..9879: note = derived and/or modified CDS sequence (wt) from DENV-1__JQ045641__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtggcccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacatccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacctatggaatacaaatactcgtggaaaagctggggaaaggctaaaatcataggggcagatgtacagaacaccaccttcatcatagatggcccaaacaccccagaatgccctgatgaccaaagagcatggaacatttgggaagttgaggactatggatttggaattttcacgacaaacatatggctgaaattgcgcgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccaatgtttgctgtagggctattatttcgcagactaacatccagagaagttcttcttctaacaattggattgagtctagtggcatctgtggagttaccaaattccctggaggagctgggggatggacttgcaatgggcattatgattctaaaattattaactgattttcaatcacatcagctgtgggccaccttgctgtccttgacatttatcaaaacaacgctttccttgcactatgcatggaagacaatggctatggtactgtcaattgtatctctcttccctttatgcctgtccacgacctcccaaaaaacaacatggcttccggtgttattgggatcccttggatgtaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacaccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccataataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaagaaacaaccaggtgctggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcataactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaagggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgacattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggttgaaaagaatggcaatcagcggagatgactgcgtggtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6191 - RNA, 9879 nt, synthetic construct
  misc_feature 1..9879: note = derived and/or modified CDS sequence (wt) from DENV-1__JQ045642__SS-prME
  source 1..9879: mol_type = other RNA
tctgtgaccatgctccttatgctgatgcctacagccttggcgttccacttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatgtgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacagggctagactttaatgaaatggtgttgttgacaatgaaagaaaaatcatggctagttcacaaacaatggtttttagacctaccactgccttggacctcgggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgtactagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggctatactgggagacactgcatgggactttggttctataggaggagtgttcacgtctgttggaaaattagtacaccagatttttggaactgcatatggagttttgttcagcggtgtttcctggaccatgaaaataggaataggggttttgctgacatggctgggactaaactcaaggagcacgtctctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgcctcgagaacatcatgtggaagcaaatatcaaatgaactgaatcacattttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagacgggtgctggtacggcatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaatgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtattattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaggaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctctatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtaaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaattttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgtcccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataacataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagctcccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtgctgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatcagaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagacatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacagcagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaaactaggagagttcggaaaggcaaaaggaagtcgtgcaatatggtacatgtggttgggagcacgctttctagagttcgaggctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattaccgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttggccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatacttaggaaaaagggaagaccaatggtgtggatccctgataggcttaacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 6192 - RNA, 9879 nt, synthetic construct
  misc_feature 1..9879: note = derived and/or modified CDS sequence (wt) from DENV-1__JQ045644__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattatttttattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgccgacgaacgtttgtggacagaggctggggcaatggttgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaatatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccgcttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaactattgactgattttcaatcacatcagctgtgggccaccttgctgtccttaacatttatcaaaacaacgttttccttgcactacgcatggaagacaatggctatggtactgtcaattgtatctctcttccctttatgcctgtccacgacctcccaaaaaacaacatggcttccggtgttattgggatctcttggatgcaaaccactaaccatgtttcttatagcagaaaacaaaatctggggaaggagaagttggcctctcaatgaaggaatcatggctgttggaatagtcagcatcctactaagttcactccttaaaaatgatgtaccgctagctgggccactaatagctggaggcatgctaatagcatgttatgttatatctggaagctcagccgacctatcattagagaaagcggccgaggtctcctgggaagaagaagcagaacactctggcgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacctagccctccagaagtggaaagagcagttcttgatgatggtatctatagaattatgcaaagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgatccaattgagcaggaaaacctttgatacagagtaccaaaaaacaaaaaacaacgactgggactacgtcgtcacaacagacatctcagaaatgggagcaaatttccgagctgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgcccactggacagaagcaaaaatgctccttgataatataaacacaccagaagggattatcccagccctcttcgagccagagagagaaaagagtgcagcaatagacggtgaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcttagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagcgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctaaagaaagtcacagaagtgaagggatatacaaaaggaggacctggacatgaggaaccaatcccaatggcgacctatggatggaacctagtaaagttgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaatcttgaatccctacatgccaagtgtggtggaaaccctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggattcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaggtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggaatctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctcattatgaaggatgggagggaaatagtggtgccatgccgcaaccaagatgaacttgtgggtagggccagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgaaagtgatcccgaaggggcactctggtga

SEQ ID NO: 6193 - RNA, 9879 nt, synthetic construct
  misc_feature 1..9879: note = derived and/or modified CDS sequence (wt) from DENV-1__JQ045648__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacccagaacaggactagactttaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagatcaaatacgaaggaacagatgcaccatgcaagatccctttttcgacccaagatgaaaaaggagtggcccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacatccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacctatggaatacaaatactcgtggaaaagctggggaaaggctaaaatcataggggcagatgtacagaacaccactttcatcatagatggcccaaacaccccagaatgccctgatgaccaaagagcatggaacatttgggaagttgaggactatggatttggaattttcacgacaaacatatggctgaaattgcgcgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccaatgtttgctgtagggctattatttcgcagactaacatccagagaagttcttcttctaacaattggattgagtctagtggcatctgtggagttaccaaattccctggaggagctgggggatggacttgcaatgggcattatgattttaaaattattgactgattttcaatcacatcagctgtgggccaccttgctgtccttgacatttatcaaaacaacgctttccttgcactatgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacaccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccataataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgctggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcataactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaagggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgacattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtggtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaagtcatatgcacaaatgtggcagctgatgtacttccacaggagagacctgagactagccgctaatgctatctgttcagccgttccagttgattggatcccaaccacatgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6194 - RNA, 9879 nt, synthetic construct
  misc_feature 1..9879: note = derived and/or modified CDS sequence (wt) from DENV-1__JQ045649__SS-prME
  source 1..9879: mol_type = other RNA
tctgtgaccatgctccttatgctgatgcctacagccttggcgttccacttgactacacgagggggagagccgcacatgatagtcagcaagcaggaaagaggaaagtcactcttgtttaagacctcagcaggtgtcaacatgtgcacccttatagcgatggatttgggagagttatgtgaggacacgatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaatattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggtgttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctagaaagtgaaatgataattccaaagatctatggaggaccaatatctcagcacaactacagaccaggatattttacacaaacagcagggccgtggcacctaggcaagttggaactggattttgatctgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcagggaaaaggaagaaaatctagtcaaatcaatggtctctgcagggtcaggggaagtggacagtttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacctttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggcctccttgctgtccttgacatttatcaaaacaacgttttccttgcactacgcatggaagacaatggctatggtactgtcagttgtatctctcttccctttatgcctgtccacgacctcccaaaaaactacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagcgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggcccagagcgtgtcattttagcaggaccaatgccagtgactgtggccagtgccgcccagaggagaggaagaattggaaggaaccataataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatccattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtctatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttaagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctccactggctggaaaagtatggcgtcgaaaggctgaaaagaatggcaatcagcggagatgactgcgtagtgaaaccaattgatgatagatttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggagcactctggtga

SEQ ID NO: 6195 - RNA, 9879 nt, synthetic construct
  misc_feature 1..9879: note = derived and/or modified CDS sequence (wt) from DENV-1__JQ045650__SS-prME
  source 1..9879: mol_type = other RNA
tctgtgaccatgctccttatgctgatgcctacagccttggcgttccacttgactacacgagggggagagccgcacatgatagtcagcaagcaggaaagaggaaagtcactcttgtttaagacctcagcaggtgtcaacatgtgcacccttatagcgatggatttgggagagttatgtgaggacacgatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggccgagacccagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaatattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggtgttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctagaaagtgaaatgataattccaaagatctatggaggaccaatatctcagcacaactacagaccaggatattttacacaaacagcagggccgtggcacctaggcaagttggaactggattttgatctgtgtgagggtaccacggttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcagggaaaaggaagaaaatctagtcaaatcaatggtctctgcagggtcaggggaagtggacagtttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatggttggagccaacgcttccgacaggatggggatgggaacgacgtacctagccctgatggccacctttaaaatgagaccaatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggcctccttgctgtccttgacatttatcaaaacaacgttttccttgcactacgcatggaagacaatggctatggtactgtcagttgtatctctcttccctttatgcctgtccacgacctcccaaaaaactacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagcgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaatgactgggactacgtcgtcacaacagacatctccgaaatgggagcaaatttccgagccgacagggtgatagacccaagacggtgtctgaaaccggtaatactaaaagatggcccagagcgtgtcattttagcaggaccaatgccagtgactgtggccagtgccgcccagaggagaggaagaattggaaggaaccataataaagaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggagaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatccattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtctatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctgggcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggggaaggactccacaaacttggatatatactcagagacatatcaaagattccagggggaaacatgtatgcagatgacacagccggatgggatacaaggataacagaggatgaccttaagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctccactggctggaaaagtatggcgtcgaaaggctgaaaagaatggcaatcagcggagatgactgcgtagtgaaaccaattgatgatagatttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggccagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6196 - RNA, 9879 nt, synthetic construct
  misc_feature 1..9879: note = derived and/or modified CDS sequence (wt) from DENV-1__JQ045651__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaagggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacaaaacaccaccttcatcatcgatggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagtcgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggggccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgtcatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccactatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccttaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgctgcacaactccgaacaaggaggaagagcctatagacatgcaatggaagaactgccagacaccatagaaacgttgatgctcctagctttgatagctgtgctaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctaaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaatatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttgggaagatgttccatatttaggaaaaagggaagaccagtggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6197 - RNA, 9879 nt, synthetic construct
  misc_feature 1..9879: note = derived and/or modified CDS sequence (wt) from DENV-1__JQ045652__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatctttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaagggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatccgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacaaaacaccaccttcatcatcgatggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacaggccaggatattttacacaaacagcagggccgtggcacctaggcaagttggaactggattttgatttgtgtgagggtaccacagtcgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggggccaacgcttccgacaggatggggatgggaacgacgtacctagccctgatggccacttttaaaatgagaccaatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgtcatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccactatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccttaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcactgacttcccaggcaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgctgcacaactccgaacaaggaggaagagcctatagacatgcaatggaagaactgccagacaccatagaaacgttgatgctcctagctttgatagctgtgctaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccttgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctaaccacgctttgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaatatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttgtaccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaatgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaatcactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggccagagtatcacaaggtgcaggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6198 - RNA, 9879 nt, synthetic construct
  misc_feature 1..9879: note = derived and/or modified CDS sequence (wt) from DENV-1__JQ045653__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcatcttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccactaccgactcaagatgtccaacacaaggagaagccacactagtggaagaacaagacgcgaactttgtgtgtcgacgaacgcttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactatggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaagagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgaccctaaaagggatgtcatatgtgatgtgcacaggctcattcaagctagagaaagaattggctgagacccagcatggaaccgttctagtgcagattaaatacgaaggaacagatgcaccatgcaagatccccttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttctgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgacatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccggaatgccctgatgaccaaagagcatggaacatttgggaagttgaggactatggatttggaattttcacgacaaacatatggctgaaattgcgtgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaagatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtaaaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcactgcgcatggaagacaatggctatgatattgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctaaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggatacacccagccctccagaagtggaaagagcagttcttgatgatggtatctatagaattatgcagagaggactgttgggcaggtcccaagtaggggtaggagttttccaagaagacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcacgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggctagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactacgacctcgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccggagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacattgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggtgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgactggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6199 - RNA, 9879 nt, synthetic construct
  misc_feature 1..9879: note = derived and/or modified CDS sequence (wt) from DENV-1__JQ045657__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaagtgccctcgaatcactgaggcggaaccagatgacgttgattgttggtgcaatgccacagacacatgggtgacctatggaacatgttcccaaactggcgagcaccgacgcgacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattctgctaatgctggtaacaccatccatggcaatgcgatgtgtgggaataggcagcagggacttcgtggaaggactgtcaggagcaacttgggtagatgtggtactggaacatggaagttgcgtcaccaccatggcaaaagacaaaccaacactggacattgaactcttgaagacggaagtcacaaaccctgccgtcctgcgtaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggatgtgggctcttcggaaaaggaagcctaataacgtgtgctaagttcaagtgtgttacaaaactggaaggaaagatagttcaatatgaaaacttgaaatattcagtaatagtcacagtccacactggagaccagcaccaggtgggaaatgaaagcacagaacatgggacaactgcaactataacacctcaagctccttcgacggaaatacagctgactgactacggagctcttacattggattgttcacctagaacaggactagactttaatgaaatggtgttgttgacaatgaaagaaaaatcatggctagtccacaaacaatggtttctagacctaccattgccttggacctcgggagcttcaacatcacaagagacttggaacagaaaagatttgctggtgacattcaagacagctcatgcaaagaagcaggaagtagtcgtactaggatcacaagaaggagcaatgcacactgcgttgaccggagcaacagaaatccaaacgtctggaacgacaacaatttttgcaggacatttgaaatgcagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagactaataacagctaatcccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactaggagacaccgcatgggactttggttctataggaggagtgttcacgtctgttggaaaattagtacaccagatttttggaactgcatatggagttttgttcagcggtgtttcctggaccatgaaaataggaataggagttctgctaacatggctaggattaaactcaaggagcacgtccctttcgatgacgtgcattgcagttggcctagtaacattatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggcgtgtgtggaatacgatcaacaactcgtctcgagaacatcatgtggaagcaaatatcaaatgaactgaaccacatcttacttgaaaatgacatgaaattcacagtggttgtaggagatgttgctggaatcttggctcaaggaaaaaaaatgattaggccacaacccatggaatacaaatactcgtggaaaagctggggaaaggctaaaatcataggggcagatgtgcagaataccaccttcatcatcgacggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccattaaggacagcaaggcagttcacgctgacatggggtactggatagaaagtgaaaagaacgagacctggaagctggcaagagcctctttcatagaagttaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagttacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgaggtccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtaggactattattccgcagactaacatccagagaagtactccttctaacaattggattgagtttagtggcatctgtggagttaccaaattccttggaggagctgggggatggacttgcaatgggcattatgattttaaaattattgactgactttcaatcacatcagttgtgggctaccttgctgtccttgacatttatcaaaacaacattttccttgcactatgcatggaagacaatggccatggtactgtcaattgtatctctcttccccttatgcctgtccacgacttcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtctcaggggtgtacccattatcaataccagcgaccctttttgtgtggtacttttggcagaaaaagaaacaaagatctggagtgttatgggacacacctagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtgaaaaaagacctaatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggcacatctggatctcccatcgtgaacagagaaggaaaaatagtaggtctttacggaaatggagtagtgacaacaagtggaacctacgttagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagctactcccccaggatcagtggaggcctttccacagagcaacgcagttatccaagatgaggaaagagacattcctgagagatcatggaactcaggctatgagtggatcactgacttcccgggtaaaacagtttggtttgttccaagcatcaaatcaggaaatgacattgccaactgcttaagaaagaatgggaaacgggtgattcaattgagcagaaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctcctcgataatataaacacaccagaagggattatcccagccctcttcgagccggagagagaaaagagtgcagcaatagacggggaatatagactacggggtgaagcaaggaaaacgtttgtggagcttatgagaagaggagatctacctgtctggctatcctacaaagttgcctcagaaggctttcagtactctgacagaagatggtgctttgatggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaggaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgctgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcggctatattgatgggacttgataaaggatggccaatatcgaagatggacataggagttccacttcttgccttggggtgctattcccaggtgaatccactgacgctgacagcggcggtgttgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggactacatgggccttgtgcgaatccatcacactagccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacttataaaaggagtgggatcatggaagtggacagatccgaagccaaagagggactgaaaagaggagaaacaaccaaacacgcagtgtcgagaggaacagctaaactgaggtggtttgtggagaggaatcttgtgaaaccagaagggaaagtcatagaccttggttgtggaagaggtggctggtcatactattgcgccgggctgaagaaagtcacagaagtgaagggatatacgaaaggaggacctggacatgaggagccaattccaatggcgacctatggatggaatctagtaaaactgcactccgggaaagacgtattctttgtaccacccgagaaatgtgacacccttttgtgtgatattggtgagtcctctccaaatccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacgtatgaaagagacgtggacctaggcgccggaacaagacatgtggcagtggaacctgaggtagccaacctagatatcattggccagaggatagagaacataaaacatgaacataagtcaacatggcattatgatgaggacaatccatataaaacatgggcctaccacggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgttcaaagagaaagttgacacacgcacaccaaaagcaaaacgaggcacagcacagatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcgattctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtatatgtggctgggagcacgctttctagagttcgaagctcttggcttcatgaacgaagatcactggttcagcagagagaattcactcagcggagtggaaggagaaggactccacaaacttggatatatactcagagacatatcaaagattccaggaggaaacatgtatgcagatgacacagccggatgggatacaaggataacagaggatgaccttcagaacgaggccagaattactgacatcatggaacccgaacatgccctactggctaagtcaatcttcaaactaacataccaaaacaaggtggtaagggtacagagaccagcaaaaaatggaaccgtgatggatgtcatatccagacgtgaccagagaggaagtggccaggtcggaacttatggcttaaacactttcaccaacatggaagcccagctgataagacagatggagtctgaggaaattttttcacccagcgaattagagaccccaaatttagccgggagagttctcgactggctggaaaaacatggcgtcgaaaggctgaaacgaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaactcacatatccagttggggagatgttccatatttaggaaaaagggaagatcaatggtgtggatccctgataggcttgacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6200 - RNA, 9879 nt, synthetic construct
  misc_feature 1..9879: note = derived and/or modified CDS sequence (wt) from DENV-1__JQ045659__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcctgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagggtggagacttgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgttggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagcaacccagaatgggagattgataacagctaaccccatagtcactgacaaagaaaaaccagtcaacattgaggcagaaccgccctttggtgagagttacatcgtaataggagcaggggaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtgataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgatatgaaattcacagtggttgtaggagatgttactgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgctgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctatggagttaccaaattccttggaggagctgggggatggacttgcaatgggcattatgattctaaaattattgactgattttcaatcacatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttattgggatcccttggatgtaaaccactaacaatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaaaaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcaacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctttatggaaatggagtagtgacaacgagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaacgggaaacgggtgattcaattgagcaggaaaacctttgatacagagtaccaaaaaacaaaaaacaacgactgggactacgtcgtcacaacagacatctctgaaatgggagcaaatttccgagccgacagggtgatagacccaagacggtgtctgaaaccggtaatactaaaagatggtcctgagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaagaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattctggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataagaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatacacaaaaggaggacctggacatgaggaaccaatcccaatggcgacctatggatggaacctagtaaagctgcactctgggaaagacgtattctttataccacctgagaaatgtgacacccttttgtgcgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagagaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacctagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggggctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6201 - RNA, 9879 nt, synthetic construct
  misc_feature 1..9879: note = derived and/or modified CDS sequence (wt) from DENV-1__JQ045661__SS-prME
  source 1..9879: mol_type = other RNA
tctgtgaccatgctccttatgctgatgcctacagccttggcgttccatttgactacgcgagggggagagccgcacatgatagtcagcaagcaggaaagaggaaagtcactcttgtttaagacctcagcaggtgtcaacatgtgcacccttatagcgatggatttgggagagttatgtgaggacacgatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtaggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccttccatggccatgcgatgcgtgggaataggcagcagggacttcgtggaaggactgtcaggagcaacttgggtagatgtggtactggaacatggaagttgcgtcaccaccatggcaaaagacaaaccaacattggatattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacactggagaccagcaccaagtgggaaatgaaagcacagaacatgggacaactgcaactataacacctcaagctcctacgacggaaatacagctgaccgactacggagctcttacattggattgttcacctagaacaggactagacttcaatgaaatggtgttgttgacaatgaaagaaaaatcatggctagtccacaaacaatggtttttagacctaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtacagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctcctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaacacaaatattcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacactcaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtacctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgctgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagtttttcactaggactgctatgcatatcaataatgatcgaggaggtgatgagatccagatggagtagaaaaatgctgatgactggtacactggctgtgttcttccttctcatagtgggacaattgacatggaacgatctgatcagattatgcatcatgattggagccaacgcttccgacaggatggggatgggaacgacgtacctagccctgatggccacctttaaaatgagaccgatgtttgctgtagggctattatttcgcagactaacatccagagaagttcttcttctaacaattggattgagtctagtggcatctgtggagttaccaaattccttggaggagctgggggatggactcgcaatgggcattatgattttaaaattattgactgattttcaatcacatcagctgtgggccaccttgctgtccttgacatttatcaaaacaacgttttccttgcactacgcatggaagacaatggctatggtactgtcagttgtatctctcttccctttatgcctgtccacgacctcccaaaaaactacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaattttcatgacagccactcccccaggatcagtggaggcctttccacagagcaatgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccataataaagaaggtgatcagtacatctacatgggacagcctttaaacaacgatgaagatcacgctcactggacggaagcaaaaatgctccttgataatataaacacaccagaagggattatcccagccctcttcgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattctcaggtgaatccactgacgctgacagcggcagtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaatatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggataatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcagtggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaagtatggcgttgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacttgggccaccaacatacaagtggccataaaccaagtgagaagactaattgggaatgagaattatctagattacatgacatcaatgaagagattcaagaacgagagtgatcccgaaggggcactctggtga

SEQ ID NO: 6202 - RNA, 9879 nt, synthetic construct
  misc_feature 1..9879: note = derived and/or modified CDS sequence (wt) from DENV-1__JQ045663__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactagtggaagaacaagacgcgaactttgtgtgtcgacgaacgtttgtggacagaggttggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcccacgacggaaatacagctgaccgactacggagctctcacattggattgttcacctagaacaggactagactttaatgaaatggtgttgttgacaatgaaagaaaaatcatggctagtccacaaacaatggttcttagacctaccactgccttggacttcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagtgacccagaatgggagattgataacagctaaccccatagttactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaactcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaagcaccccagaatgccctgatgaccaaagagcatggaacatttgggaagttgaggactatggatttggaattttcacgacaaacatatggctgaaattgcgtgattcccacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgctgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccctggaggagctgggggatggacttgcaatgggcattatgattttaaaattattgactgattttcaatcacatcagctgtgggccaccttgctgtccttgacatttatcaaaacaacgttttccttgcactatgcatggaagacaatggctatggtactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaactccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaacaaggaaggtgaccagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggcgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacactatagaaacgttgatgctcctagctttgatagctgtgttaactggtggagtgacactgttcctcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccaactggcatatgtggtgataggtctgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattattactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagctatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatacatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaacttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttgacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 6203 - RNA, 9879 nt, synthetic construct
  misc_feature 1..9879: note = derived and/or modified CDS sequence (wt) from DENV-1__JQ045665__SS-prME
  source 1..9879: mol_type = other RNA
tctgtgaccatgctccttatgctgatgcctacagccttggcgttccatttgactgcacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccccgccgtcctgcgcaaactgtgcattgaagccaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaggagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagcaacccagaatgggagattgataacagctaaccccatagttactgacaaagaaaaaccagtcaacattgaggcagaaccgccctttggtgaaagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgcgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtgaatgaacattgtggaaatcgaggaccatctcttaggaccacaacagtcacagggaagataattcatgaatggtgttgcagatcttgcacgctaccacccttacgcttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagattgagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcaccacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccactatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcatgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcaccgacttcccaggtaaaacagtttggtttgttccaagcattaaatcaggaaatgacattgccaactgcttaagaaagaatgggaaacgggtgattcaactgagcaggaaaacctttgatacagagtaccaaaaaacaaaaaacaacgactgggactacgtcgtcacaacagacatctccgagatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaatcgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgttatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagcaactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggatcatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattcttcataccacctgagaaatgtgacacccttttgtgtgatattggtgagtcctctccgaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaagacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagacatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccacatgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6204 - RNA, 9879 nt, synthetic construct
  misc_feature 1..9879: note = derived and/or modified CDS sequence (wt) from DENV-1__JQ045666__SS-prME
  source 1..9879: mol_type = other RNA
tctgtgaccatgctccttatgctgatgcctacagccttggcgttccatttgactgcacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggagacttgggccttgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccccgccgtcctgcgcaaactgtgcattgaagccaaaatatcaaacaccaccaccgactcaagatgtccaacacaaggagaagccacactagtggaagaacaagacgcgaactttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcaccgttcacaccggagaccagcaccaagtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggttagtccacaaacaatggtttttagacctaccactgccttggacctcgggagcttcaacatcacaggagacttggaacagacaagatctgctggtgacatttaagacagctcatgcaaagaagcaggaagtagtcgtgctaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaattggctgagacccagcatggaaccgttctagtgcagattaaatacgaaggaacagatgcaccatgcaagatccctttttcgacccaagatgaaaaaggagcaacccagaatgggagattgataacagctaaccccatagttactgacaaagaaaaaccagtcaacattgaggcagaaccgccctttggtgaaagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcctacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgcgattcctacacccaagtgtgtgaccaccggcttatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtgaatgaacattgtggaaatcgaggaccatctcttaggaccacaacagtcacagggaagataattcatgaatggtgttgcagatcttgcacgctaccacccttacgcttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaggaggtgatgagatccagattgagtagaaaaatgctgatgactggtacactggctgtgttcttccttctcataatgggacaattgacatggaacgatctgatcagattatgcatcatggttggagccaacgcttccgacaggatggggatgggaacgacgtacctagccctgatggccacttttaaaatgagaccgatgtttgctgtagggctattatttcgcagactaacatccagagaagttcttcttctaacaattggattgagcctagtggcatctgtggagttaccaaattccttggaggagctgggggatggacttgcaatgggcattatgattttaaaattattgactgattttcaatcacatcagctgtgggccaccttgctgtccttgacatttatcaaaacaacgttttccttgcaccacgcatggaagacaatggctatgatactgtcaattgtatctctcttccctttatgcctgtccacgacctcccaaaaaacaacatggcttccggtgttattgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatagcatgttatgttatatctggaagctcagccgacctatcattagagaaagcggctgaggtctcctgggaagaagaagcagaacactctggtgcctcacacaacatattagtggaagtccaagatgatggaaccatgaagataaaggatgaagagagagatgacacgctaaccattctccttaaagcaactctgttagcagtttcaggggtgtacccactatcaataccagcgacccttttcgtgtggtacttttggcagaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagattggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtgaacagagaaggaaaaatagtaggtctttatggaaatggagtagtgacaacaagtggaacctatgtcagtgccatagctcaagccaaagcatcacaagaagggcccctaccagagattgaagacgaggtgttcaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacatacaggaaaagagatagttgacctaatgtgtcatgccactttcaccatgcgcctcctgtctcccgtaagagttcccaattacaacatgatcatcatggatgaagcacatttcactgatccatccagtatagcggccagagggtacatctcaacccgagtgggcatgggtgaagcagctgcaatcttcatgacagccactcccccaggatcagtggaggcctttccacagagcaatgcagttatccaagatgaggaaagagacattcctgagagatcatggaactcaggctatgagtggatcaccgacttcccaggtaaaacagtttggtttgttccaagcattaaatcaggaaatgacattgccaactgcttaagaaagaatgggaaacgggtgattcaactgagcaggaaaacctttgatacagagtaccaaaaaacaaaaaacaacgactgggactacgtcgtcacaacagacatctccgagatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccagagagagaaaagagtgcagcaatagacggggaatacagactgcggggtgaagcaaggaaatcgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgttatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagcaactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacactacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggatcatggaagtggacagatccgaagccaaagaaggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattcttcataccacctgagaaatgtgacacccttttgtgtgatattggtgagtcctctccgaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaagacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtagaaccagaggtagccaacctagacatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccctatggtcacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgctacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccagaattactgacatcatggaacccgaacatgccctactggctaagtcaatcttcaagttaacttaccaaaataaggtggtaagggtacagagaccagcaaaaaatggaaccgtgatggatgtcatatccagacgtgaccagagaggaagtggtcaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagttgatgtacttccacaggagagacctgagactagccgctaatgctatctgttcagccgttccagttgattggatcccaaccagccgtaccacctggtcgatccatgcccatcaccaatggatgacgacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6205 - RNA, 9879 nt, synthetic construct
  misc_feature 1..9879: note = derived and/or modified CDS sequence (wt) from DENV-1__JQ045667__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttatgtgaggacacaatgacttacaaatgccctcgaatcactgaaactgaaccagatgacgttgattgttggtgtaatgccacagacacatgggtgacctatggaacatgttcccaaactggcgagcaccgacgggacaaacgttccgtcgcactggccccacacgtgggacttggtttggaaacaagaaccgaaacgtggatgtcctctgaaggcgcttggaaacagatacaaagagtggagacctgggccctgagacacccaggattcacggtgatagctctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagctgcgtcaccaccatggcaaaagacaaaccaacattggatattgaactcttgaagacggaagtcacaaaccctgccatcctgcgcaaactgtgcattgaagctaaaatatcaaacaccaccaccaactcaagatgtccaacacaaggagaagccacactagtggaagaacaagacgcgaactttgtgtgccgacgaacgtttgtggacagaggctggggcaatggctgtgggctcttcggaaaaggaagcctaataacgtgtgctaagttcaagtgtgtgacaaaactggaaggaaagatagttcaatatgagaacttgaaatattcagtaatagtcactgttcacaccggagatcagcaccaagtgggaaatgaaagcacagaacatgggacaactgcaactataacacctcaagctcctacgacggaaatacagctgaccgactacggagctcttacattggattgttcacctagaacaggactagattttaatgaaatggtgttgttgacaatgaaaggaaaatcatggctagtccacaaacaatggtttttagacctaccactgccttggacctcgggagcttcaacatcacaagagacttggaacagacaagatttgttggtgacatttaagacagctcatgcaaagaagcaggaagtagtcgtactgggatcacaagaaggagcaatgcacactgcattgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaagtacgaaggaacagatgcaccatgcaagatccctttttcgacccaagatgaaaaaggagtaacccagaatgggagattgataacagctaaccccatagtcactgacaaagaaaaaccagtcaacattgaggcagaaccgccctttggtgagagttacatcgtaataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaagataggaataggggttctgctgacatggctgggactaaactcaaggagcacgtccctttcgatgacgtgcattgcagttggcctagtaacactatacctaggagtcatggttcaggcggattcaggatgtgtaataaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattagatcagcaactcgtctcgagaacatcatgtggaagcaaatatcaaatgaactgaatcacatcttacttgaaaatgacatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcattgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagtccacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatattttacacaaacagcagggccgtggcacctaggcaagttggaactggattttgatttgtgtgagggtaccacagttgttgtggatgaacattgtggaaatcgaggaccatctcttaggaccacaacagtcacagggaagataattcatgaatggtgttgcagatcttgcacgctaccacccttacgtttcagaggagaagatgggtgctggtacggtatggagatcagaccagtcaaggaaaaggaagaaaatctagtcaaatcaatggtctctgcagggtcaggggaagtggacagcttttcactaggactgctatgcatatcaataatgatcgaggaggtgatgagatccagatggagtagaaaaatgctgatgactggaacactggctgtgttcttccttctcataatgggacaattgacatggaacgatctgatcagattatgcatcatggttggagccaatgcttccgacaggatggggatgggaacgacgtacctagccctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgattttcaatcatatcagctgtgggccaccttgctgtccttgacatttatcaaaacaacgttttccttgcactacgcatggaagacaatggctatggtactgtcaattgtatctctcttccctttatgcctgtccacgacctcccaaaaaacaacatggcttccggtgttactgggatcccttggatgcaaaccactaaccatgtttcttatagcagaaaacaaaatctggggaaggagaagttggcccctcaatgaaggaatcatggctgttggaatagtcagcatcctactaagttcactcctcaaaaatgatgtaccgctagctgggccactaatagctggaggcatgctaatggcatgttatgttatatctggaagctcagccgacctatcattagagaaagcggctgaggtctcctgggaagaagaagcagaacattctggtgcctcacacaacatattagtggaagtccaaggcgatggaaccatgaagataaaggatgaagagagagatgacacgctaaccattctccttaaagcaactctgttagcagtttcaggggtgtacccattatcaataccagcgacccttttcgtgtggtacttttggcagaaaaagaaacagagatctggagtgttatgggacacacccagccctccagaagtgggaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagattggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgctctagactttaaacctggcacatctggatctcccatcgtgaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtctggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtcctgagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctctttgagccagagagagaaaagagtgcagcaatagacggggaatacagactgcggggtgaagcaaggaaaacgtttgtggagctcatgagaagaggagatctacctgtctggctatcctacaaagttgcctcagaaggcttccagtactccgacagaagatggtgctttgacggggaaaggaataaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatttaatattagaaatagggaagcttccacaacacttgacgcaaagggcccagaatgccttggacaacctggttatgttacacaactccgaacaaggaggaagagcctatagacatgcaatggaagaactgccagacaccatagaaacgttgatgctcctagctctgatagctgtgttgactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctttatgcagtggccacaacaattatcactcccatgatgaggcacacaatcgaaaacacaactgcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattatgccataattggacctggactgcaagcaaaagctactagagaagctcaaaaaaggacagcggccggaataatgaaaaatccaaccgttgatggaattgttgcaatagatttggaccctgtggtttatgatgcaaaatttgaaaaacaactaggccaaataatgttgttgatactatgcacatcacagatcctcttgatgcggactacatgggccttgtgcgagtccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacatctacaagaggagtgggattatggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctacccatgaaatgtattgggtttcatgtggaacaggaaacatcgtgtcagcagtaaacatgacatctagaatgctgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcgtccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacggggcacaatacaaatcatggaggtgacagccaagtggttatggggctttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggctgggatacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggccaggtcggaacttacggtttaaacactttcaccaacatggaagcccagctgataagacaaatggagtctgagggaatcttttcacctagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttgacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcaccaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6206 - RNA, 9879 nt, synthetic construct
  misc_feature 1..9879: note = derived and/or modified CDS sequence (wt) from DENV-1__KU094071__SS-prME
  source 1..9879: mol_type = other RNA
tccgtgaccatgctccttatgctgctgcccacagccctggcgttccatctgaccacacgagggggagagccgcacatgatagttagcaagcaggaaagaggaaagtcacttttgtttaagacctctgcaggtgtcaacatgtgcacccttattgcgatggatttgggagagttatgtgaggacacaatgacctacaaatgccctcggatcactaaggcggaaccagatgacgttgactgttggtgcaatgccacggacacatgggtgacctatggaacgtgttctcaaactggcgaacaccgacgagacaagcgttccgtcgcactggccccacatgtggggcttggtctagaaacaagagccgaaacgtggatgtcctctgaaggcgcttggaaacaaatacaaaaagtggagacttgggctctgagacacccaggattcacggtaatagccctctttctagcacatgccataggaacatccatcacccagaaagggattattttcattttgttgatgctggtaacaccatccatggccatgcgatgcgtgggaataggcaacagagacttcgtggaaggactgtcaggaggaacgtgggtggatgtggtactggagcatggaagttgcgtcaccaccatggcaaaagataaaccaacattggacattgaactcttgaagacggaggtcacaaaccctgccgtcctgcgtaaactgtgcattgaagctaaaatatcaaacaccaccaccgattcaagatgtccaacacaaggggaagccacactggtggaagaacaagacgcgaactttgtgtgtcgacgaacgtttgtggacagaggctggggcaatggttgtgggcttttcggaaaaggtagcctaataacgtgtgctaagttcaagtgtgtgacaaaactggaaggaaagattgttcaatatgagaacttgaaatattcagtgatagtcaccgtccacactggtgaccagcaccaggtgggaaatgagaccacagaacatggaacaattgcaaccataacacctcaagctcctacgtcggaaatacagctgaccgactacggagctcttacattggattgctcacccagaacagggctagactttaatgagatggtgttgttgacaatgaaaagaaaatcatggcttgtccacaaacaatggtttctagacttaccactgccctggacctcgggagcttcaacaccccaagagacttggaacagagaagatttgctggttacatttaagacagctcatgcaaagaagcaggaagtagtcgtactaggatcacaagaaggagcaatgcacactgcgttgaccggagcgacagaaatccaaacgtctggaacgacaaaaatttttgcaggacacttgaaatgtagactaaaaatggacaaactgaccttaaaagggatgtcatatgtgatgtgcacaggctcattcaagttagagaaagaagtggctgagacccagcatggaactgttctagtgcaggttaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccaccttttggtgagagttacatcgtggtaggagcaggtgaaaaagctctgaaactaagctggttcaagaaaggaagcagcatagggaaaatgcttgaagcaactgcccgaggagcacgaaggatggccatcctaggagacaccgcatgggacttcggttctataggaggagtgttcacgtctgtgggaaaactggtacaccagatctttggaactgcatatggagttttgttcagcggtgtttcctggactatgaaaataggaatagggattctgctgacatggctaggattaaattcaaggagcgcgtccctttcgatgacgtgcattgcagttggcatggttacactgtacctaggagtcatggttcaggcggactcgggatgtgtaattaactggaaaggcagagaactcaaatgtggaagtggcatttttgtcaccaatgaagttcacacttggacagaacaatacaaattccgggccgactccccaaagagactatcagcagccattgggaaggcatgggaagagggtgtgtgtggaattcgatcagccactcgtctcgagaacatcatgtggaagcagatatcgaatgaactaaaccacatcttacttgaaaatgacatgaaattcacagtggtcgtaggagatgttagtgggatcttgacccaaggaagaaaaatgattgggccacaacccatggaacacaaatactcgtggaaaagctggggaaaagccaaaatcataggagcagatgtacagaacaccaccttcattatcgacggcccaaacaccccagaatgccctgatgaccaaagagcatggaacatttgggaagttgaggactatggatttggaattttcacgacaaatatatggttgaaattgcgtgactcctacacccaagtgtgtgacccccggctaatgtcagctgccattaaggacagcaaggcagttcatgccgatatgggatactggatagaaagtgaaaagaacgagacctggaggctggcgagagcctccttcatagaagttaagacatgcgtctggccaaaatcccacactctatggagcaacggagttttggaaagtgaaatgataatcccaaagatatatggaggaccaatatctcagcacaactacagaccaggatattccacacaaacagcaggaccgtggcacctaggcaagttggaactagattttgatttgtgtgagggtaccacagttgttgtggatgaacattgtggaaatcgaggaccatctcttagaaccacaacagtaacaggaaagataatccatgaatggtgctgtagatcttgtacgctaccccccttacgtttcaaaggagaagacgggtgttggtacggcatggaaatcagaccagtcaaggacaaggaagagaacctagtaaagtcattggtctctgcagggtcaggagaagtggatagcttttcactaggactgttatgcgtatcaataatgatcgaagaggtgatgagatccagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatagccacttttaaaatgagaccaatgttcgctgtcgggttattatttcgcagactaacatctagagaagttcttcttcttacgattggattgagtctggtggcatctgtggagctaccaaattccttggaggagctgggggatggacttgcaatgggcatcatgattttaaaattactgactgactttcagtcacatcagctgtgggctgccctgctgtccttgacatttatcaaaacaactttttcattgcactatgcatggaagacaatggctatggtactgtcaactgtatctctcttccctttatgcctgtccacgacctctcgaaaaacaacatggcttccggtgctgttgggatctcttggatgcaaaccactaaccatgtttcttatagcagaaaacaaaatctggggaaggaaaagttggcccctcaatgaaggaatcatggctgttggaatagttagcatcctactaagttcactcctcaagaatgacgtgccgctagccggcccactaatagctggaggtatgctaatagcatgttatgttatatccggaagctcagccgatttatcactggagaaagcggctgaggtctcctgggaagaagaagcagaacactctggtgcctcacacaacatactagtggaagtccaagatgatggaaccatgaagataaaagatgaagagagagatgacacactcaccattctccttaaagcaactctgttggcagtctcaggggtgtacccaatatcaataccagcgaccctttttgtgtggtattttcggcagaaaaagaaacagagatcaggagtgctatgggacacacctagccctccagaagtggaaagagcagttcttgatgatggtatctatagaattctgcaaagaggactgttgggtaggtcccaggtaggagtaggagttttccaagaaggcgtgttccacacaatgtggcatgtcaccaggggagctgtcctcatgtatcaagggaagagactggaaccgagttgggccagtgtcaaaaaagacttgatctcatatggaggaggttggaggtttcaaggatcctggaacacgggagaagaagtgcaggtgattgctgttgaaccggggaaaaaccccaaaaacgtacagacagcgccgggcaccttcaagacccctgaaggcgaagttggagtcatagccctagattttaaacccggcacatctggatctcccattgtgaacagagagggaaaaatagtaggtctttatggaaatggagtggtgacaacaagtggaacctacgtcagtgccatagctcaagctaaagcatcacaagaagggcctctaccagagattgaggacgaggtgtttaggaaaagaaacttaacaataatggacctacatccaggatcggggaaaacaagaagatatcttccagccatagtccgtgaggctataaaaaggaagctgcgtacgctaatcttggctcccacaagagttgtcgcttctgaaatggcagaggcgctcaagggaatgccaataaggtatcagacaacagcagtgaagagtgaacacacaggaagggagatagttgaccttatgtgccatgccactttcaccatgcgtctcctgtctcccgtgagagttcccaattacaacatgatcatcatggatgaagcacatttcaccgatccagccagtatagcggccagagggtacatctcaacccgggtgggcatgggtgaagcagctgcgatcttcatgacagccactcccccaggatcggtggaggcctttccacagagcaatgcagttatccaagatgaggaaagagacattcctgagagatcatggaactcaggctatgactggatcactgatttcccaggtaaaacagtctggtttgttccaagcattaaatcaggaaatgacattgccaactgtttaagaaagaatgggaaacgggtgatccaattgagcagaaaaacctttgatactgagtaccagaaaacaaaaaataatgactgggactatgtcgtcacaacagacatttccgaaatgggagcaaacttccgagccgacagggtaatagacccaagacggtgttcgaaaccggtaatactaaaagatggtccagagcgtgtcattctagccggaccgatgccagtgactgtggccagtgccgcccagaggagaggaagaattggaaggaaccaaaataaggaaggtgatcagtacatttacatgggacagcctttaaacaacgatgaggatcacgctcattggacagaagcaaaaatgctccttgacaacataaacacaccagaagggattatcccagccctctttgagccggagagaggaaaaagtgcagcaatagacggggaatacagactgcggggtgaagcaaggaaaacgtttgtggagctcatgagaagaggagatctacctgtctggctatcctacaaagttgcctcagaaggcttccagtactctgacagaaagtggtgctttgatggggaaaggaacaaccaggtgttggaggagaacatggacgtggagatctggacaaaagaaggagaaagaaagaaactacgaccccgctggctggacgccagaacatactctgacccacaggctctgcgcgagtttaaagagtttgcagcaggaagaagaagcgtctcaggtgatctaatattagaaatagggaaacttccacaacatttgacgcaaagggcccagaatgctctggacaacctggtcatgttgcacaactccgaacaaggaggaaaagcctatagacatgctatggaagaactaccagacaccatagaaacgttgatgctcctagctttgatagctgtgttaactggtggagtgacgctgttcttcctatcaggaagaggcctagggaaaacatctatcggcctactctgcgtgatggcttcaagcgtactgttatgggtggccagtgtggagccccattggatagcggcctccatcatactggagttctttctgatggtgctgcttattccagagccagacagacaacgcactccacaggacaaccagctggcatatgtggtgataggtttgttattcatgatattgacagtagcagccaatgagatgggattattggaaaccacaaagaaagacctagggattggccatgtggctgttgaaaaccaccaccatgccacaatgctggacgtagacttacgtccagcttcagcctggaccctctatgcagtggccacaacaatcatcactcccatgatgagacacacaattgaaaacacaacggcaaatatttccctgacagctattgcaaaccaggcagctatattgatgggacttgacaagggatggccaatatcgaagatggacataggagttccactcctcgccttggggtgctattcccaggtgaacccgccgacgctgatagcggcggtattgatgctagtggctcattacgccataattggacctggactgcaagcaaaagccactagagaagctcaaaaaagaacagcggccggaataatgaaaaatccaactgtcgacggaattgttgcaatagatttggaccctgtggtttatgatgcaaaatttgaaaaacagctaggccaaataatgttgttgatactttgcacatcacagattctctcgatgcggactacatgggccttgtgtgaatccatcacactggctactggacctctgaccacgctttgggagggatctccaggaaaattctggaacaccacgatcgcggtgtccatggcaaacattttcaggggaagttatctagcaggagcaggtctggccttcccattaatgaaatctctaggaggaggtaggagaggtacgggagcccaaggggaaacactgggagaaaaatggaaaagacagctaaaccaactgagcaagtcagaattcaacacttacaaaaggagtgggattatggaggtggatagatctgaagctaaagagggattgaaaagaggagaaacaaccaaacatgcagtgtcgagaggaacagccaaactgaggtggtttgtggagaggaaccttgtgaagccggaagggaaagtcatagacctcggttgtggaagaggtggctggtcatattattgtgctgggctgaagaaagtcacagaagtgaaaggatatacaaaaggaggacctggacatgaggaaccaatcccaatggcgacctatggatggaacctagtaaagctacactccgggaaagatgtattctttacaccacctgagaaatgtgacacccttttgtgtgatattggtgagtcctctccgaacccaactatagaagaaggaagaacgttacgtgttctaaagatggtggaaccatggctcagaggaaaccaattttgcataaaaattctaaatccctatatgccgagtgtggtggaaactctggagcaaatgcaaagaaaacatggaggaatgctagtgcgaaatccactctcaagaaattccacccatgaaatgtactgggtttcatgtggaacaggaaacattgtgtcagcagtaaacatgacatctagaatgttgctaaatcgattcacaatggctcacaggaagccaacatatgaaagagacgtggacttaggtgctggaacaagacatgtggcagtggaaccagaggtagccaacctagatatcattggccagaggatagagaatataaaaaatgagcataagtcaacatggcattatgatgaggacaatccatacaaaacatgggcctatcatggatcatatgaggttaagccatcaggatcagcctcatccatggtcaatggcgtggtgagattgctcaccaaaccatgggatgttatccctatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaaaaaaccaagaatctgcacaagagaggagttcacaagaaaagtcaggtcaaacgcagctattggagcagtgttcgttgatgaaaatcaatggaactcagcaaaagaagcggtggaagatgaacggttctgggaccttgtgcacagagagagggagctccataaacagggaaaatgtgccacgtgtgtttacaatatgatggggaagagagagaaaaaattaggagagttcggaaaggcaaaaggaagtcgtgcaatatggtacatgtggttgggagcacgctttctagagttcgaagcccttggtttcatgaacgaagatcactggttcagtagagagaattcactcagtggagtggaaggagaaggactccacaaacttggatatatactcagagacatatcaaagattccagggggaaatatgtatgcagatgacacagccggatgggacacaagaataacagaggatgatcttcagaatgaggccaaaatcactgacatcatggagcccgaacatgccctattggctacgtcaatctttaagctgacctaccaaaacaaggtggtaagggtgcagagaccagcaaaaaatggaaccgtgatggatgtcatatccagacgtgaccagagaggaagtggacaggtcggaacttatggcttaaacactttcactaacatggaggtccaactaataagacaaatggagtctgagggaatcttttcacccagcgaattggagaccccaaatttagccgaaagagttctcgactggttggaaaaacatggcgtcgaaaggctgaaaagaatggcaatcagcggagatgactgtgtggtgaaaccaactgatgacaggttcgctacagccttaacagctttgaatgacatgggaaaagtaagaaaagacataccgcaatgggaaccttcaaaaggatggaatgattggcaacaagtgcctttttgttcacaccatttccaccagctgatcatgaaggatgggagggagatagtggtgccatgccgcaaccaagatgaacttgtgggtagggctagagtatcacaaggcgccggatggagcctgagagaaactgcatgcctaggcaagtcatatgcacagatgtggcagctgatgtacttccacaggagagacctgagactagcggccaatgccatctgttcagccgttccaattgattgggtcccaaccagccgcaccacctggtcgatccatgcccatcatcaatggatgacaacagaagacatgttgtcagtgtggaatagggtttggatagaggaaaacccatggatggaggataaaacccatgtatccagttgggaagatgttccatacttaggaaaaagggaagatcagtggtgtggatccctgataggcttaacagcaagggccacctgggccactaatatacaagtggccataaaccaagtgagaaggcttattgggaatgagaattatctagattacatgacatcaatgaagagattcaaggatgagagtgatctcgaaggggcactctggtaa

SEQ ID NO: 6207 - RNA, 9879 nt, synthetic construct
  misc_feature 1..9879: note = derived and/or modified CDS sequence (wt) from DENV-1__HQ624983__SS-prME
  source 1..9879: mol_type = other RNA
tctgtgaccatgctccttatgctggtgcctacagccttggcgttccatttgaccacacgagggggagagccgcacatgatagtcagcaagcaggaaagaggaaagtcacttttgtttaagacctcagcaggtgtcaacatgtgcacccttatagcgatggatttgggagagttttgtgaggacacaatgacttacaaatgccctcgaatctctgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggcaatgcgatgtgtgggaataggcagcagggacttcgtagaaggactgtcaggagcaacttgggtagatgtggtactggaacatggaagttgcgtcaccaccatggcaaaagacaaaccaacattggacattgaactcttgaagacggaagtcacaaaccctgccgtcctgcgtaaactgtgcattgaagctaaaatatcaaataccaccactgactcaagatgtccaacacaaggagaagccacactggtagaagaacaagacgcgaactttgtgtgtcgacgaacgtttgtggacagaggctggggcaatggatgtgggctcttcggaaaaggaagcctaataacgtgtgctaagttcaagtgtgtgacaaaactggaaggaaagatagttcaatatgaaaacttgaaatattcagtaatagtcaccgtccacactggagaccagcaccaggtgggaaatgaaagcacagaacatgggacaactgcaactataacacctcaagctccttcgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacgtcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaagctgactctaaaagggatgtcatatgtaatgtgcacaggctcattcaagctagagaaagaagtggctgagacccagcatggaaccgttctagtgcagattaaatatgaaggaacagatgcaccatgcaagattcctttttcgacccaagatgaaaaaggagtaactcagaatggaagactgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagataccgcatgggactttggttctataggaggagtgttcacgtctgttggaaaattagtacaccagatttttggaaccgcatatggagttttgttcagcggtgtttcctggaccatgaaaataggaataggggttctgctgacatggctaggattaaactcaaggagcacgtccctttcgatgacgtgcattgcagttggcttagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaatacgatcagcaactcgtctcgagaacatcatgtggaagcaaatatcaaatgaactgaaccacattttacttgaaaatgacatgaaattcacagtggttgtaggagatgttgctggaattttggctcaagggaaaaaaatgattaggccacaacccatggaatacaagtactcgtggaaaagctggggaaaggctaaaatcataggggcagatgtgcagaacaccaccttcatcatcgacggcccaaacaccccagaatgccctgatgaccaaagagcatggaacatttgggaagttgaggactatggatttggaattttcacgacgaacatatggctgaaattgcgtgattcctatacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaagtcccacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcaaaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaatgacgtacctagctctgatggccacttttaaaatgagaccaatgtttgctgtaggactattattccgcagactaacatccagagaagttcttcttctaacaattggattgagtctagtggcatctgtggagttaccaaattccttggaggagctgggggatggacttgcaatgggcattatgattctaaaattattgactgactttcaatcacatcagttgtgggccaccttgctgtccttgacatttatcaaaacaacgttttccttgcactatgcatggaagacaatggccatggtactgtcaattgtatctctctttcccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcacttctcaaaaatgatgtgccgctagctgggccactgatagccggaggcatgctaatagcatgttatgttatatctggaagctcagccgacctatcactagagaaagcagctgaggtctcctgggaagaagaagcagaacactctggtgcctcacataacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaagatagtaggtctttacggaaatggagtagtgacaacaagtggaacctacgtcagtgccatagctcaagccaaagcatcacaagaagggcctctaccagagattgaagacgaggtgtttaggaaaagaaacttaacaataatggacctacatccaggatcggggaaaacaagaagatatcttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcactatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcatcaaatcaggaaatgacattgccaactgcttaagaaagaatgggaaacgggtgattcaattgagcaggaaaacttttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcatgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggctttcagtactctgacagaagatggtgctttgacggggaaaggaacaaccaggtgttggaggagaacatggacgtggagatctggacaaaagaaggagaaagaaagaaactaagaccccgctggctggatgctagaacatactcagacccactggccctgcgcgagtttaaagagtttgcagcaggaagaagaagcgtctcaggtgatctaatactagaaatagggaaacttccacaacacttgacgcaaagggcccagaatgccttggacaatctggttatgttgcacaactccgaacaaggaggaagagcctatagacatgcaatggaagaactgccagacaccatagaaacgttgatgctcctggctttgatagctgtgttgactggtggagtgacgctgttcttcctatcaggaaggggcctagggaaaacatctatcggcctactctgcgtgatggcttcaagcgtactgctatggatggccagtgtggagccccattggatagcggcctccatcatactggaattcttcctgatggtgctgcttattccagagccagacagacaacgcactccgcaggacaaccagctggcatatgtggtgataggtttgttattcatgatactgacagtagcagccaatgagatgggactgctggaaaccacaaagaaagatttagggattggccatgtggctgttgaaaatcaccaccatgccgcaatgctggacgtagacttacatccagcttcagcctggaccctctatgcagtggccacaacaattatcactcccatgatgaggcacacaatagaaaacacaacggcaaacatttccctgacagccattgcaaaccaggcggctatattaatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggatcctgtggtttatgatgcaaaatttgagaaacaactaggccaaataatgttgttgatactatgcacatcacaaatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccatctgagcaagtcagaattcaacacttataaaaggagtgggatcatggaagtggacagatccgaagccaaagagggactgaaaagaggagaaacaaccaaacatgcagtgtcgagaggaaccgctaaactgaggtggtttgtggagaggaatcttgtgaaaccagaagggaaagtcatagacctcggttgtggaagaggtggctggtcatactattgcgccgggctgaagaaagtcacagaagtgaagggatatacaaaaggaggacctggacatgaggagccaattccaatggcgacctatggatggaacctagtaaaactgcactccgggaaagacgtattctttgtaccacccgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaagcatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtagcagtggaaccagaggtagccaacctagatatcattggccagaggatagagaacataaaacatgaacataagtcaacatggcattatgatgaggacaatccatacaaaacatgggcctaccatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgcgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagatttcagggggaaacatgtatgcagatgacacagccggatgggatacaaggataacagaggatgaccttcagaacgaggccaaaattactgacatcatggaacccgaacatgccctactggctaattcaatcttcaagctaacataccaaaataaggtggtaagggtacagagaccagcaaaaaatggaaccgtgatggatgtcatatctagacgtgaccagagaggaagtggccaggttggaacttatggcttaaatactttcaccaacatggaagcccagctgataagacagatggagtctgaaggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagttagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtctatccatgcccatcaccaatggatgacagcagaagacatgctgtcagtgtggaatagggtttggatagaggaaaacccatggatggaggacaaaacccatatatccagttgggaagatgttccatatttaggaaaaagggaagatcaatggtgtggatccctgataggcttaacagcaagggccacctgggccactaacatacaagtggccataaaccaagtgagaaggctaattgggaatgagaattatctagattacatgacatcaatgaagagattcaagaacgagagtgatcctgaaggggcactctggtga

SEQ ID NO: 6208 - RNA, 9879 nt, synthetic construct
  misc_feature 1..9879: note = derived and/or modified CDS sequence (wt) from DENV-1__FJ384655__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaactgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcccacgtcggaaatacagctgactgactacggagccctcacattggactgttcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggactttggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaagggaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggcaccacagttgttgtggatgaacattgtggaaatcgaggtccatctctcagaactacaacagtcacaggaaagataatccatgaatggtgttgcagatcctgcacgctaccccccttacggttcagaggagaagacggatgttggtatggcatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactagcatccagagaagttcttcttctcacgattggattaagcctggtggcatccgtggagctaccaaattctttggaggagctaggggatggacttgcaatgggtatcatgatgttaaaattattgactgaatttcagccacaccacttatggaccaccttactgtctttgacatttatcaaaacaactctttcattggattatgcatggaagacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtatcctgggaagaagaagcagaacactccggtacctcacacaacatattagtagaggttcaagatgatggagctatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaggagcggttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacaggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgagcagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcttttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggggtacagactgcggggagaagcgaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctggctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccttgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacctggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctgtcccaatggcgacctatggatggaacctagtaaagctacactctggaaaagatgtattttttatgccacctgagaaatgtgacacccttctgtgtgatattggtgagtcctctccgaatccaactatagaagaaggtagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtatatgtggctgggagcacgttttctggagttcgaagcccttggcttcatgaatgaagatcactggtttagtagagagaattcactcagtggagtggaaggagaaggactgcacaaacttggatacatactcagagacatatcaaagattccggggggaaatatgtatgcagatgatacagccggatgggatacaagaataacagaggatgatcttcagaatgaggctaaaatcactgacatcatggagcctgaacatgctctattggctacgtcaatttttaagctgacttaccaaaataaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgtgtagtgaaaccaattgatgacaggttcgcaacagccttaatagctctgaatgacatgggaaaagtaagaaaagacataccgcagtgggaaccttcaaaaggatggaatgattggcagcaagtgcctttctgttcacaccattttcaccagttgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactggcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 6209 - RNA, 9879 nt, synthetic construct
  misc_feature 1..9879: note = derived and/or modified CDS sequence (wt) from DENV-1__KC759167__SS-prME
  source 1..9879: mol_type = other RNA
tctgtgaccatgctccttatgctgatgcccacagccttggcgttccatttgaccacacgagggggagagccgcacatgatagtcagcaagcaggaaagaggaaaatcactcctgtttaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgttcccaaactggcgagcaccgacgagacaaacgttccgtcgcactggcaccacacgtgggacttggtttggaaacaagaaccgaaacgtggatgtcctctgaaggcgcttggaaacagatacaaagagtggagacttgggccctgagacacccaggattcacagtgatagccctttttctagcacatgccataggaacatccgtcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactatgcattgaagctaaaatatcaaacaccaccaccgactcaagatgtccaacacaaggagaagctccagaagtggaagaacaagacgcgaactttgtgtgtcgacgaacgtttgtggacagaggctggggcaatggctgcgggctctttggaaaagggagcctaataacgtgtgccaagttcaagtgtgtgacaaaactggaaggaaagatagttcaatatgaaaacttgaaatattcagtaatagtcaccgttcacaccggagaccagcatcaggtgggaaatgaaagcacagaacatgggacaactgcaaccataacacctcaagctcctacgacggaaatacagctgactgactatggagctcttacattggattgttcacctagaacaggactagactttaatgaaatggtgttgttgacaatgaaagaaaaatcatggctagtccacaaacaatggtttctagacctaccactgccttggacctcgggagcttcgacatcacaagagacttggaacagacaagatttgctggtgacatttaagacagcccatgcaaagaagcaggaagtagtcgtgctaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcaaaaccgccttttggtgagagttgcatcgtaataggagcaggtgaaaaagctttgaaactaagctggtttaagaaaggaagcagcatagggaaaatgtttgaggcaactgctagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggtctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagtaaggcagttcacgctgacatggggtactggatagaaagtgaaaagaacgagacctggaagctggcaagagcttctttcatagaagtcaaaacatgtatctggccaaaatcccacactttatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgccaccacccctacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggagcactggctgtgttcctccttctcataatgggacaattgacatggaatgatctgatcagattatgcatcatggttggagccaacgcttccgacagaatggggatgggaacgacgtacctagctctgatggccacttttaaaatgagaccgatgtttgctgtagggctattatttcgcaaactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcgattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagctcacttctcaaaaatgatgtgccgctagctgggccactaatagctggaggcatgttaatagcatgttatgttatatctggaagctcagccgacctatcactagagaaagcggctgaggtctcctgggaagaagaagcagaacactctggtgcctcacacaacatactagtggaggtccaagatgatggaaccatgaagataaaggatgaagagagagatgacacgctaaccattctccttaaagcaactctgctagcggtttcaggggtgtacccattatcaataccagcgacccttttcgtgtggtacttttggcggaaaaagaaacagagatctggagtgttatgggacacacccagccctccagaagtggaaagagcagttcttgatgatggtatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacttgatctcatatggaggaggttggaggcttcaaggatcctggaacacaggagaaggagtgcaggtgattgctgttgaaccagggaaaaaccccaaaaatgtacaaacagcgccgggcacctttaagacccctgaaggtgaagttggagctattgccctagattttaaacccggcacatctggatctcccatcgtgaacagagaaggaaaaatagtaggtctttatggaaatggagtagtgacaacaagtggaacttacgtcagtgccatagctcaagccaaggcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataagataccaaacaacagcagtgaagagtgaatacacaggaaaagagatagttgacctcatgtgtcatgccactttcaccatgcgcctcctgtctcccgtgagagttcccaattacaacatgattattatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagtaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcaggaaaacctttgatacagagtaccaaaaaacaaaaaacaacgactgggactatgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaggcaaggaaaacgtatgtggagctcatgagaagaggagatctacctgtttggctatcttacaaagttgcctcagaaggcttccagtactctgacagaagatggtactttgacggggaaaggaacaaccaggtgttggaggagaacatggacgtggagatctggacaaaagagggagaaagaaagaaactacgaccccgctggctggatgccagaacatactcagacccactagccctgcgcgagtttaaagagtttgcagcagggagaagaagcgtctcaggtgatctaatattggaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaagggatggccaatatcgaagatggacataggagttccacttctcgccttgggctgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagttagaatttaactcctataaaaggagtgggattatggaagtggacagatccgaagccaaagagggattgaaaagaggagaaacaaccaaacatgcagtgtcgagaggaaccgctaaactgagatggtttgtggagaggaaccttgtgaaaccagaagggaaagtcatagacctcggttgtggaagaggcggctggtcatactattgcgctgggctgaagaaagtcacagaagtgaagggatatacaaaagggggacctggacatgaggaaccaatcccaatggcgacctatggatggaacctagtaaagctgcactctgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactctcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgctggaacaagacatgtggcagtggaaccagaggtagctaacctagatatcattggccagaggatagagaacataaaacatgaacataagtcaacatggcattatgatgaggacaatccatataaaacatgggcctatcacggatcatatgaggtcaagccatcaggatcatcctcatccatggtcaatggcgtggtgaaactgctcaccaagccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagctacacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaactgtgatggatgtcatatccagacgtgaccagagaggaagtggccaggtcggaacttatggcttaaacactttcaccaacatggaagcccagctgataagacaaatggagtctgaggaaatcttttcacccagcgaattagagaccccaaatttagccgagagagttctcgactggctggaaaaatatggcatcgaaaggctgaaaagaatggcaatcagcggagatgattgcgtggtgaaaccaattgataataggtttgcaacagccttaacagctctgaatgacatgggaaaagtaagaaaggatataccacaatgggaaccttcaaaaggatggaatgattggcaacaagtgcctctttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtatggaatagggtttggatagaggaaaacccatggatggaggacaaaacccatatatccagttggggagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6210 - RNA, 9879 nt, synthetic construct
  misc_feature 1..9879: note = derived and/or modified CDS sequence (wt) from DENV-1__JQ048541__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgttggaacatggaagttgcgtcactaccatggcaaaagataaaccaacattggacattgaactcttgaagacggaagtcacaaaccctgccgtcttgcgcaaactgtgcattgaagctaaaatatcaaacaccaccaccgactcaagatgtccaacacaaggagaagccacattggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgttcacctagaacaggactggacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgcgactcctacacccaagtgtgtgaccaccggctaatgtcagctgccattaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaaactcagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaactgacatggaatgatctgatcagatcatgcatcatggttggagccaacgcttccgacaggatggggatgggaacgacgtacctagctctgatggccacttttaaaatgagaccaatgtttgccgtagggctactattccgcagactaacatccagagaagttcttcttctaacaattggattgagtctagtggcatctgtggagttaccaaattccttggaggagctgggggatggacttgcaatgggcattatgatcttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccattgatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaactatgaagataaaggatgaagagagagatgacacgctaaccattctcctcaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtgggggtaggagtgtttcaagaaaacgtgttccacacaatgtggcatgtcaccaggggagctgtactcatgtatcaagggaagagactggaaccgagctgggccagtgtcaaaaaagacctaatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtggtgacaacaagtggaacctacgtcagtgccatagctcaagccaaagcatcacaagaagggcccctaccagagattgaagacgaggtgtttaggaaaagaaacttaacaataatggacctgcatccaggatcgggaaaaacaagaagataccttccagccatagtccgtgaggccataaaaaggaagctgcgcacattaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttattcaagatgaggaaagagacattcctgagagatcatggaattcaggttatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcggcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtaacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccacaatgctggacgtagacttacatccagcttcagcctggaccctctatgcagtggccacaacaattatcactcccatgatgaggcacacaatcgaaaacacaacagcaaacatttccctgacagccatcgcaaaccaggcagctatattgatgggacttgacaaaggatggccaatatcgaagatggacataggagttccacttctcgccttggggtgctattcccaggtgaatccactgacgctgacagcggcggtattgatgctagtggcccattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgctgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagaccttggttgtggaagaggtggctggtcatactattgcgctgggctgaagaaagtcacagaagtgaagggatacacaaaaggaggacctggacacgaagaaccaatcccaatggcgacctatggatggaacctagtaaagctgtactccgggaaagacgtattctttatgccacctgagaagtgtgacacccttttgtgtgatattggtgagtcctctccaaacccaactatagaggaaggaagaacgctacgcgtcctaaagatggtggaaccatggctcagaggaaaccaattttgcataaaagttctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcataggaaaccaacatatgaaagagacgtggacctaggcgccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagtcaggtcaaacgcagccatcggagcagtgtttattgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaactcactcagcggagtggaaggagaaggactccacaaacttggatatatactcagagacatatcaaagattccagggggaaacatgtatgctgatgacacagccggatgggatacaaggataacagaggatgaccttcagaatgaggccaaaattactgacatcatggaacccgaacatgccctactagctaaggcaatcttcaagctaacctaccaaaataaagtggtaagggtacagagaccagcaaaaaatggaactgtgatggatgtcatttccagacgtgaccagagaggaagtggccaggtcggaacttatggcttaaacactttcaccaacatggaagcccagctgataagacaaatggagtctgagggaatcttctcacctagtgaattagagaccccaaatttggccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggggcctgagagaaaccgcatgcctaggcaaatcatatgcacaaatgtggcagctgatgtacttccacaggagagacctgagactagctgctaatgctatctgttcagccgttccagttgattgggtcccaactagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6211 - RNA, 9879 nt, synthetic construct
  misc_feature 1..9879: note = derived and/or modified CDS sequence (wt) from DENV-1__JN697056__SS-prME
  source 1..9879: mol_type = other RNA
tctgtgaccatgctcctcatgctgctgcccacagccctgacgttccatttgaccacccgagggggagagccgcacatgatagttagcaaacaggaaagaggaaagtcactcttgtttaagacctctgcaggtgtcaacatgtgcacccttattgcaatggacctgggagagttatgtgatgacacgatgacctacaaatgcccccggatcactgagacggaaccagatgacgttgactgttggtgcaatgccacagagacgtgggtgacctatggaacatgttctcaaaccggtgaacaccgacgagacaaacgttccgttgcactggcaccacacatagggcttggtctggaaacaagaaccgaaacgtggatgtcctctgaaggcgcttggagacaaatacaaaaagtggagacatgggccctgagacacccaggattcacggtgatagccctttttctagcacatgccataggaacatccatcactcagaaagggattattttcattttgctgatgctggtaactccatccatggccatgcggtgcgtgggaataggaaacagagacttcgtggaaggactgtcaggagctacgtgggtggatgtagtactggagcatggaagttgcgtcactaccatggcaaaagacaaaccaacactggacattgaactcttgaagacggaggtcacaaaccctgccgtcctgcgcaaactgtgcattgaagccaaaatatcaaataccaccactgattcgagatgtccgacacaaggagaagccacgctggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacattggactgttcacccagaacagggctagactttaatgagatggtgttgttgacaatgaaagaaaaatcatggctcgtccacaaacaatggtttttagacctaccactgccttggacctcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggtcatctgaaatgcagactaaaaatggacaaactgactctaaaaggaatatcatatgtaatgtgcacaggcccattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaacattgaggcggagccaccttttggtgagagctacatcgtggtaggagcaggagaaaaagctttgaaactaagctggttcaagaagggaagcagcatagggaaaatgtttgaagcaactgcccgtggagcacgaaggatggccatcctgggagacaccgcatgggacttcggttctataggaggagtgttcacgtctgtgggaaaactggtacaccagatttttggaactgcgtacggagttttgttcagtggtgtctcttggaccatgaaaataggaatagggattctgctgacatggctgggattaaactcaaggagcacgtctctttcaatgacgtgtatcgcagttggcatgatcacactgtacctaggagtcatggtccaggcggactcgggatgtgtaatcaactggaaaggcagagaactcaaatgtggaagcggcatttttgtcaccaatgaagttcacacctggacagagcaatataaatttcaggccgactccccaaagagactatcagcagccattgggaaggcatgggaggaaggtgtgtgtggaattcgatcagccactcgtcttgagaacatcatgtggaagcaaatatcaaatgaattaaaccacatcttacttgaaaatgacatgaaatttacagtggtcgtaggagacgttagtggaatcttggcccagggaaagaaatcgattaggccacaacccatggaacataaatactcgtggaaaagctggggaaaagccaaaatcattggagcagatgttcagaacaccactttcatcatcgacggcccaaacaccccagaatgccctgatgaccaaagagcatggaacatctgggaagttgaagattatggatttggaattttcacgacaaacatatggttgaaattgcgtgactcctacacccaagtgtgtgatcatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtcccacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtggatgaacactgtggaaatagaggaccatctcttagaaccacaacagtcacaggaaagataatccatgaatggtgctgtagatcttgcacgttaccccccctacgtttcaaaggagaagatgggtgctggtatggcatggaaatcagaccagtcaaggagaaggaagagaacctagtcaagtcaatggtctctgcagggtcaggagaggtggacagtttttcactaggactgttatgcatatcaataatgatcgaagaggtaatgagatccagatggagcaagaaaatgctgatgactggaacattggctgtgttcctccttctcacaatgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttcttacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcctccctttatgcctgtccacgacttctcaaaaaacgacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggagggatgctaatagcatgttatgttatatccggaagctcagccgatttatcactggagaaagcggctgaggtctcctgggaagaagaagcagaacactctggtgcctcacacaatatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaggaaacagagatcaggagtgctatgggacacaccaagccctccagaagtggaaagagcagtccttgatgatggcatttatagaattctccaaagaggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaagacgaggtgtttaggaaaagaaacctaacaataatggacctacacccaggatcgggaaaaacaagaagataccttccagccatagtccgtgaggccataaaaagaaaactgcgcacgctagttttagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcctaattacaacatgataatcatggatgaagcacatttcaccgatccagccagcatagcagccagagggtacatctcaacccgagtgggtatgggtgaagcagctgcgattttcatgacagccactccccctggatcggtggaggcctttccacagagcaatgcagttatcctagatgaggaaaaagacattcctgaaagatcatggaattcaggctatgactggatcactgattttccaggtaaaacagtctggtttgttccaagcatcaaatcaggaaatgacattgccaactgtttaagaaagaatgggaaacgggtgatccaattgagcagaaaaacttttgacactgagtaccagaaaacaaaaaataacgactgggactatgttgtcacaacagacatttctgaaatgggagcaaactttcgagccgacagggtgatagacccaaggcgatgcctgaaaccggtaatactgaaagatggtccagagcgtgtcattctagccggaccgatgccagtgactgtggctagcgccgcccagaggagaggaagaattggaaggaaccaaaataaggaaggtgatcagtatatttacatgggacagcctttaaataatgatgaggaccacgcccattggacagaagcaaaaatgctccttgacaacataaacacaccagaagggatcatcccagccctctttgagccggaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgttttgacggggaaaggaacaaccaggtgttggaggagaatatggacgtggagatctggacaaaagaaggagaaagaaagaaactacgacctcgctggctggatgccagaacatactctgacccactggctttgcgcgaattcaaagagttcgcagcaggaagaagaagtgtctcaggtgacctaatattagaaatagggaaacttccacaacatctaacgcaaagggcccagaatgctttggacaatttggttatgctgcacaactctgaacaaggaggaaaagcttatagacacgccatggaagaattgccagacaccatagagacgctgatgctcctagctctgatagctgtgctgactggtggagtgacgctgttcttcctatcaggaagaggcttagggaaaacatctattggcctactctgcgtgatgtcctcaagtgcactgttatggatggccagtgtggagccccattggatagcggcctctatcatactggagttctttctgatggtgttgcttattccagagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacttacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaaggacagcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatccccaggaaaattttggaacaccacgatagcggtgtccatggcaaacatttttagggggagttatctagcaggagcgggtctggccttttcattaatgaaatctctaggaggaggtaggagagggacgggagcccaaggagaaacgctgggagaaaagtggaaaagacagctaaaccaattgagcaagtcagaatttaacatttacaagaggagtggtattgtagaggtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatatacaaaaggaggacctggacatgaggaaccaatcccaatggcaacctatggatggaacctagtaaagctatactccgggaaagacgtattctttataccacctgaaaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctaaatcgattcacgatggctcacaggaagccaacatatgaaagagatgtggacctgggcgctggaacgagacatgtggcagtagaaccagaggtggccaacctagacatcattggccagaggatagagaatataaaaaatgaacacaaatcaacatggcattatgatgaggacaatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgacacgcgtacaccaaaagcgaaacgaggcacagcacaaattatggaggtgacagccaagtggttatggggtttcctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatggggaagagagagaaaaaattaggagagttcggaaaggctaaaggaagtcgcgcaatatggtacatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaatatgtatgcagatgatacagccggatgggacacaagaataacagaggatgatcttcagaatgaggccaaaatcactgacatcatggaacctgaacatgccctactggccacgtcaatctttaagttaacctaccaaaacaaggttgtaagggtgcagagaccagcaaaaaatggaaccgtgatggatgtcatttccaggcgtgaccagagaggaagtggacaggttggaacttatggcttaaacaccttcaccaacatgggggcccaactaataagacaaatggagtctgagggaatctttttacccagtgaattggaaactccaaatttagctggaagagtccttgactggttggaaaaacatggcattgagaggctgagaagaatggcaatcagtggagatgactgcgtggtgaaaccaattgatgacagatttgcaacagccttaacagccttgaatgacatgggaaaggtaagaaaagacataccgcaatgggaaccctcaaaaggatggaatgattggcaacaagtgcctttctgctcacaccacttccaccagctgattatgaaggatgggagggaaatagtggtgccatgccgcaaccaagatgagctggtaggtagggccagagtatcacaaggagccggatggagcttgagagaaactgcatgtctgggcaagtcgtatgcacaaatgtggcagctgatgtacttccacaggagagacttgagattagcggctaatgctatttgttcagctgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagatgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 6212 - RNA, 9879 nt, synthetic construct
  misc_feature 1..9879: note = derived and/or modified CDS sequence (wt) from DENV-1__JN697057__SS-prME
  source 1..9879: mol_type = other RNA
tctgtgaccatgctccttatgctgatgcctacagccttggcgttccatttgactacccgagggggagagcctcacatgatagtcagcaagcaggaaagaggaaagtcacttttgtttaagacctcagcaggtgtcaacatatgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggactttgtggaaggactgtccggagcaacttgggtagatgtggtgctggaacatggaagttgcgtcactaccatggcaaaagataaaccaacattggacattgaactcttgaagacggaagtcacaaaccctgccgtcctgcgtaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaatagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaagtaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactactatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgccgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggttaccttgctgtccttgacatttatcaaaacagcgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacccctgaaggcgaagttggagccattgccctagattttaaacccggcacatctggatctcccatcgtgaacagagaaaggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctgcatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggttatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggtttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagcggcccattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcgtagacctcggttgtggaagaggtggctggtcatactattgcgctgggctgaagaaagtcacagaagtgaagggatacacaaaaggaggacctggacatgaagaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcataggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactacacaaacttggatatatactcagagacatatcaaagattccagggggaaacatgtatgcagatgacacagccggatgggatacaaggataacagaggatgaccttcagaatgaggccaaaattactgacatcatggaacccaaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6213 - RNA, 9879 nt, synthetic construct
  misc_feature 1..9879: note = derived and/or modified CDS sequence (wt) from DENV-1__HQ624984__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaaatcactcttgtttaagacctcagcaggtgtcaacatgtgcacccttattgcgatggatttgggagagttatgtgaggacacaatgacttacaaatgccctcgaatcactgaagccgaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaagcgcttggaaacagatacaaagagtggagacttgggccctgagacacccaggattcacggtgatagccctttttctagcacatgccataggaacatccatcactcagaaagggattattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaattttgtgtgtcgacgaacgtttgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcaacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagctaaccctatagttactgacaaagaaaaaccagtcaacattgaggcagaaccgccttttggtgagagttacatcgtaataggagcaggtgaaaaagctttgaaactaagctggtttaagaaaggaagcagcatagggaaaatgtttgaggcaactgccagaggagcacgaaggatggccatactgggagacaccgcatgggactttggttctataggaggagtgttcacttctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccacctttatcatcgacggcccaaacaccccagaatgccctgatgaccaaagagcatggaacatttgggaagttgaggactatggatttggaattttcacgacaaacatatggctgaaattgcgtgattcctatacccaagtgtgtgaccaccggctaatgtcagctgccatcaaggacagcaaggcagttcacgctgacatggggtactggatagaaagtgaaaagaacgagacctggaaactggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacagcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagatgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcctccttctcataatgggacaattgacatggaatgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtctttgacattcatcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttcttatagcagaaaacaaaatctggggaaggagaagttggcccctcaatgaaggaatcatggctgttggaatagtcagcatcctactaagttcacttctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagagaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccaggaaaaaaccccaaaaatgtacaaacagcgccgggcacctttaagacctctgaaggtgaagttggagccattgccctagattttaaacccggaacatctggatctcccatcgtgaacagagaaggaaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgtacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcactaatccaagatgaggaaagagacattcctgagagatcatggaactcaggctatgagtggatcactgacttcccaggtaaaacagtttggtttgttccaagcattaaatcaggaaatgacatagccaactgcttaagaaagaatgggaaacgggtgattcaattgagcagaaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagagggagaaagaaagaaactacgacctcgctggctggatgccagaacatactcagacccactagccctgcgcgagtttaaagagtttgcagcagggagaagaagcgtctcaggtgatctaatattagaaatagggaaacttccacaacacttgacgcaaagggcccagaatgccttggacaacctggttatgttgcacaactccgaacaaggaggaagagcctacagacatgcaatggaagaactgccagacaccatagaaacgttgatgctcctagctttgatagctgtgttaactggtggagtgacactgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaatcagctggcatatgtggtgataggtttgttattcatgatactgacagtagcagccaatgagatgggactgctggaaaccacaaagaaagacttagggattggccatgtggctgttggaaatcaccaccatgccgcaatgctggacgtagacttgcatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgacgggattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattacggaagtggacagatccgaagccaaagagggattgaaaagaggagaaacaaccaaacatgcagtgtcgagaggaaccgctaaactgaggtggtttgtggagaggaaccttgtgaaaccagaagggaaagtcatagaccttggttgtggaagaggtggctggtcatactattgcgctgggctgaagaaagtcacagaagtgaagggatatacaaaagggggacctggacatgaggaaccaatcccaatggcgacctatggatggaacctagtaaagctgcactctgggaaagacgtgttctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatctagaatgttgctaaatcgattcacaatggctcacaggaaaccaacatatgaaagagatgtggacctaggcgccggaacaagacatgtggcagtggaaccagaggtagctaacctagatatcattggtcagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaagccatgggatgtcatccccatggttacacaaatagccatgactgacactacaccctttggacaacagagggtgtttaaagagaaagttgacacacgcacaccaaaagcaaaacgaggcacagcacaaatcatggaggtgacagccaagtggttatggggttttctttctagaaataagaaaccaagaatttgcacaagagaggagttcacaagaaaagttaggtcaaacgcagccattggagcagtgttcgttgatgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagatcactggttcagcagggagaattcactcagcggagtggaaggagaaggactccacaaacttggatatatactcagagacatatcaaagattccagggggaaacatgtatgcagatgacacagccggatgggatacaaggataactgaggatgaccttcagaatgaggccagaattactgacatcatggaacccgaacatgccctactggctaagtcaatcttcaagctgacctaccaaaataaggtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtggtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacagatgtggcagctgatgtacttccacaggagagacctgagactagccgctaatgctatctgttcagccgttccagttgattggatcccaaccagccgcaccacctggtcgatccatgcccatcaccaatggatgacaacagaagacatgctgtcagtgtggaatagggtttggatagaggaaaacccatggatggaggacaaaacccatatatccagttggggagatgttccatatttaggaaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6214 - RNA, 9879 nt, synthetic construct
  misc_feature 1..9879: note = derived and/or modified CDS sequence (wt) from DENV-1__HQ891314__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacactggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagtttaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagacttcactgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatctgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttccaaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaactttcgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttagggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcagtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggaccaggacatgaggaaccaatcccaatggcgacctatggatggaacctagtaaaactgcactccgggaaagacgtattttttataccacctgagaaatgtgatacccttttgtgtgatattggtgagtcctctccaaacccaaccatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggttacacaaatagccatgactgacaccacaccctttggacaacagagggtgtttaaagagaaagttgacacacgcacaccaaaagcaaaacgaggcacagcacaaatcatggaagtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaacgaattagagaccccaaatttagccgagagagttctcgactggctggaaaaatacggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggttccaaccagccgcaccacttggtcgatccatgcccatcaccaatggatgacaacagaagacatgctgtcagtatggaatagggtttggatagaggaaaacccatggatggaggacaaaacccgtgtatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6215 - RNA, 9879 nt, synthetic construct
  misc_feature 1..9879: note = derived and/or modified CDS sequence (wt) from DENV-1__HQ891315__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacattggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagtttaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagacttcaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatctgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaagaagagaatctagtcaaatcaatagtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcatcatgattttaaaattattgactgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaactatgtttcttatagcagaaaacaaaatctggggaaggaaaagctggcccctcaatgaagggatcatggctgttggaatagtcagcattctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggattgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggaccaggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggttacacaaatagccatgactgacaccacaccctttggacaacagagggtgtttaaagagaaagttgacacacgcacaccaaaagcaaaacgaggcacagcacaaatcatggaagtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcttgagagaaactgcatgcctaggcaagtcatatgcacaaatgtggcagctgatgtacttccacaggagagacctgagactagccgctaatgctatctgttcagccgttccagttgattgggttccaaccagccgcaccacttggtcgatccatgcccatcaccaatggatgacaacagaagacatgctgtcagtatggaatagggtttggatagaggaaaacccatggatggaggacaaaacccgtgtatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6216 - RNA, 9879 nt, synthetic construct
  misc_feature 1..9879: note = derived and/or modified CDS sequence (wt) from DENV-1__HQ891316__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcatggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacactggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagtttaagtgtgtgacaaaactggaaggaaagatagtccaatatgaaaacctgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagacttcaatgaaatggtgttgttgacaatgaaagaaaaatcgtggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagtcactgacaaagaaaaaccagtcaacattgaggcagaaccgccttttggtgagagttacatcgtgataggagctggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatctgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgctatagctcaagccaaagcatcacaagaagggcccctaccagagattgaagacgaagtgttcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgcccccgctggctggatgccagaacatactcagacccactggccctgcgcgagtttaaagagtttgcagcaggaagaagaagcgtttcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggaggagtgacgctgttcttcctatcaggaaagggcctagggaaaacatctatcggcctactctgcgtgatggcttcaagcgcactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaatacaacggcaaacatttccctgacagccattgcaaaccaggcagctatattgatgggacttgacaaaggatggccaatatcgaagatggacataggagttccacttctcgccttggggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaatattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggaccaggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaatcctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggttacacaaatagccatgactgacaccacaccctttggacaacagagggtgtttaaagagaaagttgacacacgcacaccaaaagcaaaacgaggcacagcacaaatcatggaagtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattacagacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaacgaattagagaccccaaatttagccgagagagttcttgactggctggaaaaatatggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggttccaaccagccgcaccacttggtcgatccatgcccatcaccaatggatgacaacagaagacatgctgtcagtatggaatagggtttggatagaggaaaacccatggatggaggacaaaacccgtgtatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6217 - RNA, 9879 nt, synthetic construct
  misc_feature 1..9879: note = derived and/or modified CDS sequence (wt) from DENV-1__JN054256__SS-prME
  source 1..9879: mol_type = other RNA
tctgtgaccatgctccttatgctgatgcctacagccttggcgttccatttgactacacgagagggagagccgcacatgatagtcagcaagcaggaaagaggaaagtcactcttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacactggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagtttaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacaccccaagctcctacgacggaaatacagctgaccgactacggagctcttacattggattgttcacctagaacaggattagacttcactgaaatggtgttgttgacaatgaaagaaaaatcatggctagtccacaaacaatggtttctagacttaccactgccttggacctcgggagcttcaacatcacaagagacttggaacagacaagatctgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagtcactgacaaagaaaaaccagtcaacattgaggcagaaccgccctttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaactcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatctgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgattgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttccaaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaactttcgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaatcatcactcccatgatgaggcacacaatcgaaaacacaacggcaaacatttccctgacagccattgcaaaccaggcagctatattgatgggacttgacaaaggatggccaatatcgaagatggacataggagttccacttctcgccttagggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcagtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggaccaggacatgaggaaccaatcccaatggcgacctatggatggaacctagtaaaactgcactccgggaaagacgtattttttataccacctgagaaatgtgatacccttttgtgtgatattggtgagtcctctccaaacccaaccatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggttacacaaatagccatgactgacaccacaccctttggacaacagagggtgtttaaagagaaagttgacacacgtacaccaaaagcaaaacgaggcacagcacaaatcatggaagtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaacgaattagagaccccaaatttagccgagagagttctcgactggctggaaaaatacggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgactgggttccaaccagccgcaccacttggtcgatccatgcccatcaccaatggatgacaacagaagacatgctgtcagtatggaatagggtttggatagaggaaaacccatggatggaggacaaaacccgtgtatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6218 - RNA, 9879 nt, synthetic construct
  misc_feature 1..9879: note = derived and/or modified CDS sequence (wt) from DENV-1__JN054255__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggctaaagacaaaccaacactggacattgaactcttgaagacggaagtcacaaaccctgccgtcctgcgcaaactgtgcattgaagccaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagtttaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcccacgacggaaatacagctgaccgactacggagctcttacattggattgttcacctagaacaggattagacttcaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaatgtctggaacgacaacaatttttgcaggacacttgaaatgtagactaaagatggacaaactgactctaaaagggatgtcatatgtgatgtgcacaggctcattcaagcttgagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatctgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgcccctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggacgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaaaagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtggcatagctcaagccaaagcatcacaagaagggcccctaccagagattgaagacgaagtgttcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggttcgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaaaatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaactacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgcactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacatagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaagtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactaaggtggtttgtggagaggaaccttgtgaaaccagaagggaaagtcatagacctcggttgtggaagaggtggctggtcatactattgcgctgggctgaagaaagtcacagaagtgaagggatatacaaaaggaggaccaggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcatggtgaaactgctcaccaaaccatgggatgttatccccatggttacacaaatagccatgactgacaccacaccctttggacaacagagggtgtttaaagagaaagttgacacacgcacaccaaaagcaaaacgaggcacagcacaaatcatggaagtgacagctaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaatcactgacatcatggaacccgaacatgccctactggccaagtcaatcttcaagctaacctaccaaaataaggtggtaagggtacagagaccatcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaacgaattagagaccccaaatttagccaagagagttctcgactggctggaaaaatatggcgtcgaaaggctgaaaagaatggcaatcagtggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgccatctgttcagccgttccagttgattgggttccaaccagccgcaccacttggtcgatccatgcccatcaccaatggatgacaacagaagacatgctgtcagtatggaatagggtttggatagaggaaaacccatggatggaggacaaaacccgtgtatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6219 - RNA, 9879 nt, synthetic construct
  misc_feature 1..9879: note = derived and/or modified CDS sequence (wt) from DENV-1__KP406801__SS-prME
  source 1..9879: mol_type = other RNA
tccgtgaccatgctcctcatgctgctgcccacagccctggcgttccatttgaccacacgagggggagagccacatatgatagtcagcaagcaggaaagaggaaagtcactcttgtttaagacctcggcaggtgtcaacatgtgtaccctcattgcaatggatttgggagagttgtgtgaggacacaatgacctacaaatgcccccggatcaccgaagcggaaccagatgacgttgattgctggtgcaatgccacagacacatgggtgacctatgggacgtgctctcaaactggcgaacaccgacgggacaaacgttctgtcgcattggccccacacgtggggcttggtttagaaacaagaaccgaaacgtggatgtcctctgaaggcgcctggagacagatacaaaaagtggagacttgggccttgagacacccaggattcacggtgatagcccttttcctagcacacaccataggaacatccatcacccagaaagggatcatcttcattttgctgatgctggtgacaccatcaatggccatgcgatgcgtgggaataggcaacagagacttcgttgaagggctgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaataccaccaccgattcacgatgcccaacacaaggagaagccacactggtggaagaacaggacgcgaactttgtgtgtcgacgaacattcgtggacagaggctggggtaatggttgtggactattcgggaaaggaagcttactgacgtgtgctaaattcaagtgtgtgacaaaacttgaaggaaagatagttcaatatgaaaacttaaaatattcggtgatagtcaccgtccacactggggaccagcaccaggtgggaaatgagactacagaacatggaacaattgcaaccataacacctcaagctcctacgtcggaaatacagctaactgactacggagcccttacattggactgttcacctagaacagggctggacttcaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactggggtcacaagaaggagcaatgcacactgcgttggctggggcgacagaaattcagatgtcaggaacgacgacaatcttcgcaggacacctgaagtgtagactaaaaatggataaactgactttgaaaggggtgtcatatgtgatgtgcacaggctcatttaagttagagaaggaagtagctgagactcagcatggaaccgttctagtgcaggttaaatacgaaggaacagatgcaccatgcaagattcccttttcaatccaagatgagaaaggagtgacccagaatgggagattgataacagccaatcccatagctactgataaagaaaagccagtcaacattgagacagaaccaccttttggtgagagctacatcgtgataggggcgggtgaaaaagctttgaaactaagctggttcaagaaaggaagcagcatagggaaaatgttcgaagctaccgcccggggagcacgaaggatggctatcctgggagacactgcatgggactttggttccataggaggggtgttcacatctgtgggaaaactggtacaccaggtttttggaaccgcatatggggtcttgttcagcggtgtttcttggacaatgaaaataggaatagggattctgctgacatggctaggattaaattcaaggagcacgtcactctcgatgacgtgcattgcagttggtatggtcacactgtacttaggagtcatggttcaagcggactcggggtgtgtgatcaactggaagggcagagaactcaaatgtggaagtggcatctttgtcactaatgaagtccacacttggacagagcaatataaattccaggctgattccccaaaaagactgtcagcagccattgggaaggcatgggaggaaggcgtgtgtggaattcgatcagccacacgtcttgagaacatcatgtggaagcaaatatcaaatgaattgaaccacatcctacttgaaaatgacatgaaattcacagtggtcgtaggagacgctaatggaatcttgacccaagggaaaaagatgattaggccacaacccatggaacacaaatactcatggaaaagctggggaaaagccaaaatcataggagcagacacacagaataccaccttcatcattgatggcccagacactccagaatgccccgatgaccagagagcatggaacatttgggaagttgaagactatgggtttgggattttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgagacctggaagctagcgagagcctccttcatagaagtgaaaacatgcatctggccaagatcccacactctatggagcaatggagtcttggaaagtgaaatgataatcccaaagatatatggaggaccaatatctcagcacaactacagaccagggtatttcacacaaacagcagggccatggcatctaggcaagttggaactagactttgatttgtgtgaaggcaccacagttgttgtggatgaacattgtggaaatcgaggcccatctcttagaactacaacagttacaggaaagataatccatgaatggtgttgcagatcctgcacgctacctcccttacgcttcaaaggagaagacggatgttggtacggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttcctcctcataatgggacaactgacatggaatgatctgatcaggttatgcatcatggttggagccaacgtctcagacaggatggggatgggaacaacgtacctagccttgatggctactttcaaaatgagaccgatgttcgctgttgggctattattccgcagactaacatccagagaggttctccttctcacaattggactaagcctggtggcatccgtggagctaccaaattctttagaggagctaggggacggacttgcaatgggcatcatgatgttaaaattattgactgattttcagtcacaccagttatggactaccttactgtctctgacatttattaaaacaactctttcattggattatgcatggaagacaatagccatggtattgtcaatcgtatctctctttcctttatgtctatctacgacctctcaaaaaacaacatggcttccggtgctgttaggatcttttggatgcaaaccactaaccatgtttctcataacagaaaacaaaatctggggaaggagaagttggcctctcaatgaaggaattatggctgttggaatagtcagcattttactaagttcactcctcaaaaatgatgtgccactagccggcccactaatagctggaggcatgctaatagcatgttacgtcatatccggaagctcggctgatttatcattggagaaagcagccgaggtctcctgggaagaagaagcagaacactctggtgcttcacacaacatactagtggaggtccaagatgatggaactatgaaaataaaagatgaagagagagatgacacgctcaccatactcctcaaagcaactctgttggcagtctcaggggtgtacccaatgtcaataccagcaaccctttttgtgtggtatttttggcagaaaaagaaacagagatcaggagtcttgtgggacacacccagccctccagaagtggaaagagcagttcttgatgatggtatctatagaatcttgcaaagaggactgttgggtaggtcccaagtaggagtgggagtttttcaagacggcgtgttccacacaatgtggcatgtcactaggggggctgtccttatgtaccaggggaagaggctggaaccaagctgggctagtgtcaaaaaagacttgatctcatatggaggaggttggaggtttcaaggatcatggaacacgggagaagaagtacaggtgatagctgttgagccaggaaaaaacccaaaaaatgtacagacaacgccgggtaccttcaagacccctgaaggtgaagttggagctatagccctagattttaaacccggcacatctggatctcccatcgtgaacagagagggaaaaatagtaggtctctatggaaatggagtggtgacaacaagcggaacatacgtcagtgccattgcccaagctaaagcatcacaagaagggcctctaccagagattgaggacgaggtgtttaagaaaagaaacctaacaataatggacctacatccaggatcaggaaaaacaagaagatatcttccagccatagtccgtgaagccataaaaaggaaactgcgcacgctaatcttggcccccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaactacaatatgattatcatggatgaagcacactttaccgatccagccagcatagcggctagagggtacatctcaacccgagtgggtatgggtgaagcagctgcgatcttcatgacagctactcccccaggatcggtagaggcctttccacagagcaatgcagttatacaagatgaggaaagagacattcctgagagatcatggaactcaggctacgactggatcactgattttccaggaaaaacagtctggtttgttccaagcatcaaatcaggaaatgacattgccaactgtttaagaaagaacggaaaacgggtgatccaattgagcagaaaaacctttgacactgaataccagaaaacaaaaaacaatgactgggactatgttgtcacaacagacatttctgaaatgggagcaaatttccgggccgacagggtaatagacccaaggcggtgcttgaagccagtaatactaaaagatggcccagagcgcgtcattctagccggaccaatgccagtgaccgtggccagtgctgcccagaggagaggaagaattggaaggaaccaaaacaaggaaggtgaccagtatatttatatgggacagcctttaaataatgatgaggaccacgctcattggacagaagcaaaaatgctccttgacaatataaacacgccagaagggattatcccagccctctttgagccagagagagaaaagagtgcagcaatagacggggagtacagactgcggggagaagcaaggaaaacgtttgtggagctaatgagaagaggggatctaccagtctggctatcttacaaagttgcctcagaaggcttccagtactccgacagaaggtggtgctttgacggagaaaggaacaaccaggtgttggaggagaacatggacgtggagatctggacaaaagagggagaaagaaagaaattacgacctcgatggttagatgccagaacctactctgatccactggccctgcgcgagtttaaagagttcgcagcaggaagaagaagtgtctcaggtgacctaatattagaaatagggaaacttccacagcacttgacgctaagggcccagaatgctttggacaatttggtcatgttgcacaattccgaacaggggggaaaagcctatagacatgctatggaagaactaccagacaccatagaaacattgatgctcctagctctgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttctttctgatggtgctgctcattccagagccagacagacagcgtactccacaggacaatcaattggcatatgtggtgataggcttgttattcatgatattgacagtggcagccaatgagatgggattactggaaaccacaaagaaagacctggggatcggccatgtagtcgccgaaaatcaccaccatgctacaatgctagacatagacttacatccagcttcagcctggaccctctatgcagtagctacaacaattattactcccatgatgagacacacaattgaaaacacaacggcaaatatatccctgacagctattgcaaatcaggcggctatattgatgggacttgacaagggatggccaatatcgaagatggacataggagtgccacttctcgccttagggtgctattcccaggtgaacccattgacactgacagcggcggtgttgatgttagtggcccattatgccataatcggacctggactgcaagcaaaagccactagagaagcccaaaaaaggacagcggctggaataatgaaaaatccaactgtagacggaattgttgcaatagatttggatcctgtggtttatgatgcaaaatttgaaaaacagctaggccaaataatgttattgatactttgcacatcacagattcttttgatgcggactacatgggccttatgtgaatccatcacactggctactggacccttgaccactctctgggagggttctccaggaaaattctggaataccacgatagcagtgtccatggcaaacatcttcaggggaagctatctagcaggagcaggtctggccttttcattgatgaaatctttaggaggaggcaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgagaccagaagggaaagtgatagacctcggttgtggaagaggtggctggtcatattattgtgctgggctgaagaaggttacagaagtgaagggatacacaaaaggaggacccggtcatgaggaacctatcccaatggcgacttatggatggaacttagtgaagctatactccggaaaagatgtattctttacaccacctgagaaatgtgacacccttttgtgtgatattggtgagtcctctccgaatccaactatagaagaaggaagaacgttacgcgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgctgctgaatcggttcacaatggctcacaggaagccaacatatgaaagagacgtggacttgggcgctggaacaagacatgtggcagtggaaccagagatagccaacctagacatcattggccagaggatagagaacataaaaaatgaacataagtcaacatggcattatgatgaggacaatccatataagacatgggcctatcatggatcatatgaggtcaagccatcagggtcagcctcatccatggtgaatggcgtggtgagattgctcaccaaaccatgggatgttatccccatggtcacacaaatagctatgactgataccacacccttcggacaacagagggtgttcaaagagaaagttgacacacgcacaccaagaccaaaacgaggcacagcacaaattatggaggtgacagctaagtggttgtggggtttcctctctagaaataaaaaacccagaatctgcacaagagaggagttcacaagaaaagttaggtcaaacgcagcaattggagcagtgttcgttgatgaaaaccaatggaactcagcaaaagaagcagtggaagacgaaaagttttgggaccttgtgcacagagagagggagcttcataaacagggaaaatgtgccacgtgtgtctacaacatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatatgtatgcagatgacacagctggatgggacacaagaataacagaggatgatcttcagaatgaggccaaaatcactgacatcatggagcccgaacatgctctactggctacgtcaatcttcaagctgacctatcaaaacaaggtggtaagggtgcaaagaccagcaaaaagtggaaccgtgatggatgttatatccagacgtgaccagagaggaagtggacaggtcggaacttatggtttaaacactttcactaacatggaggtccaactgataagacaaatggaatctgaaggaatcttttcacccagcgaactggaaaattcaaatctagctgagagagttctagactggctggaaaaacatggcgtcgaaaggttgaaaagaatggcaatcagcggagatgactgtgtggtgaaaccaactgatgacaggttcgcaacagctttgacagccctgaatgacatgggaaaagtgagaaaagacataccgcaatgggaaccttcaaaaggatggaatgactggcagcaagtgcctttctgttcacaccattttcaccaactgatcatgaaggatgggagggagatagtggtgccatgccgcaaccaagatgaacttgtgggcagagccagagtatcacaaggcgccggatggagcctgagagaaactgcttgcctaggcaagtcatatgcacaaatgtggcagctgatgtacttccacaggagagacctaagactagcggccaatgctatctgttcagccgttccagttgattgggtcccaaccagccgcaccacctggtcgatccatgcccaccaccaatggatgacaacagaggacatgttatcagtgtggaatagggtttggatagaggaaaacccatggatggaggacaaaactcatgtatccagctgggaagatgttccatacttaggaaaaagggaagatcaatggtgtggatccctgataggcttaacagcgagggccacctgggccaccaacatacaagtggccataaaccaagtgagaaggctcattgggaatgagaattacttagactacatgacatcaatgaagagattcaagaatgagagtgatcccgaaggagccctctggtaa

SEQ ID NO: 6220 - RNA, 9879 nt, synthetic construct
  misc_feature 1..9879: note = derived and/or modified CDS sequence (wt) from DENV-1__KP406802__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtatcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggatcatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaatttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaatcccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaatgtgttccacacaatgtggcatgtcaccaggggagctgtactcatgtatcaagggaagagactggaaccgagctgggccagtgtcaaaaaagacctgatctcatatggaggaggttggaggcttcaaggatcttggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctagctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggcagacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacttgggccaccaacatacaagtggccataaaccaagtgagaagactaattgggaatgagaattatctagattacatgacatcaatgaagagattcaagaacgagagtgatcccgaaggggcactctggtga

SEQ ID NO: 6221 - RNA, 9879 nt, synthetic construct
  misc_feature 1..9879: note = derived and/or modified CDS sequence (wt) from DENV-1__KP406803__SS-prME
  source 1..9879: mol_type = other RNA
tctgtgaccatgctcctcatgctgctgcccacagccctagcgtttcatctgaccactcggggaggagagccgcacatgatagttagcaagcaggaaagaggaaaatcacttttgtttaagacctctgcaggtgtcaacatgtgcacccttatcgcaatggatttgggagagttatgtgaggacacaatgacctacaaatgccccaggatcactgagacggagccagatgacgttgactgttggtgcaatgccacggagacatgggtgacctatggaacatgttctcaaactggtgaacaccgacgagacaaacgttccgtcgcattggcaccacacgtagggcttggcctagaaacaagaaccgaaacgtggatgtcctctgaaggtgcttggagacaaatacaaaaagtggagacttgggctctgagacacccaggattcacggtgatagccctttttttagcacatgctataggaacatccatcacccagaaagggattatttttattttgctgatgctggtaactccatccatggccatgcggtgcgtgggaataggcaacagagacttcgtggaaggactgtcaggagctacgtgggtggatgtagtactggagcatggaagttgtgtcactaccatggcaaaagacaaaccaacactggacattgaactcctgaagacggaggtcacaaaccctgcagtcctgcgcaaactgtgcattgaagctaaaatatcaaataccaccaccgattcgagatgtccaacacaaggagaagccacgctggtggaagagcaggacacgaactttgtgtgccgacgaacgttcgtggacagaggctggggcaatggttgtgggctattcggaaaaggtagcttaataacgtgtgctaagtttaagtgtgtgacaaaactggaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacaggactagactttaacgagatggtgttgttgacgatgaaagaaaaatcatggctcgtccacaaacaatggtttctggacctaccactgccttggacctcgggggcctcaacatcccaagagacttggaatagacaagacttgctggtcacatttaagacagctcatgcaaaaaagcaggaagtagtcgtactaggatcacaagaaggagcaatgcacactgcgctgactggagcgacagaaatccaaacgtctggaacgacaacaatttttgcagggcacctgaaatgcagactaaaaatggataaactgaccttaaaaggggtatcatatgtaatgtgcacagggtcattcaagctagagaaggaagtggctgagacccagcatggaactgttctagtgcaagttaaatacgaaggaacagatgcaccatgcaagatccccttctcgtcccaagatgagaagggagtaacccagaatggaagattgataacagccaaccccatagttactgacaaagaaaaaccagtcaacattgaagcggagccaccttttggtgagagctaccttgtggtaggagcaggtgaaaaagctttgaaactaagctggttcaagaagggaagcagtatagggaaaatgtttgaagcaactgcccgcggagcacgaaggatggccatcctgggagacaccgcatgggacttcggttctataggaggggtgttcacgtctgtgggaaaactgatacaccagatttttgggactgcgtatggagtcttgttcagcggggtttcttggaccatgaaaataggaatagggattctgttgacatggctaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatttttgtcaccaatgaagtccacacctggacagagcaatacaaattccaggccgactcccccaagagactatcagcggccattgggaaggcatgggaggagggtgtgtgtgggatccgatcagccactcgtctcgagaacattatgtggaagcaaatatcaaatgaattaaaccacatcttacttgaaaatgacatgaaatttacagtggtcgtaggagacgttaatggaatcttggcccaaggaaagaaaatgattaggccgcaacccatggaacacaaatactcgtggaaaagctggggaaaagccaaagtcataggagcagatgtacagaatatcaccttcatcatcgatggcccaaacaccccagaatgccctgatgatcaaagagcatggaatatctgggaagtcgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttgacaagagcctccttcatagaagttaagacatgcgtctggccaaaatcccacaccctatggagcaatggagtcttggaaagtgagatgataatcccaaagatatatggaggaccaatatcccagcacaactacagaccaggatatttcacacaaacagcagggccgtggcacttgggcaagctagaactggattttggtttatgtgaaggtaccactgttgttgtggatgaacattgtggaaatcgaggaccatctcttagaaccacaacagtcacagggaagataatccatgaatggtgctgtagatcttgcacgttaccccccctacgtttcaaaggagaagacgggtgctggtacggtatggaaatcagaccagtcaaggagaaggaagagaacctagtcaagtcaatggtctctgcagggtcaggagaagtggacagtttttcactaggactgctatgcatatcaataatgatcgaagaggtaatgagatccagatggagcagaaaaatgctgatgactggaacattggctgtgttcctccttcttataatgggacagttgacatggaatgatctgatcagactgtgtatcatggttggagccaatgcttcagacaagatggggatgggaacgacgtacctagctttgatggccactttcagaatgagaccaatgtttgcagtcgggctactgtttcgcagattaacatctagagaagttctccttcttacagttggattgagtctagtggcatctgtagaactaccaaattccttggaggagctaggggatggacttgcaatgggcatcatgatgttgaaattactgactgattttcagtcacatcaactatgggctgccttgctgtctttaacatttgtcaaaacaactttttcactgcactatgcatggaagacaatggctatgatactgtcaattgtatctctcttccctttatgtctgtccacgacttctcaaaaaacaacatggcttccggtgttgctgggatctcttggatgcaaaccactaaccatgtttcttattacagaaaacaaaatctggggaaggaaaagctggcctctcaatgagggaattatggctgttggaatagttagcattcttctaagttcacttctaaaaaatgatgtaccactagctggcccactaatagctggaggcatgctgatagcatgttatgtcatatctggaagctcggccgatttatcactggagaaagcagctgaggtctcctgggaagaagaagcagaacattctggtgcctcacacaacatactagtggaggtccaagatgatggaaccatgaagataaaagatgaagagagagatgacacacttaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggtatttatagaattctccaaagaggactgttgggcaagtctcaagtaggagtaggagtttttcaggaaggtgtgttccacacaatgtggcacgtcaccaggggagctgtcctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaaccctaaaaatgtacagacagcgccgggtacctttaaaacccctgaaggcgaagttggagccatagctctagactttaaacccggcacatctggatctcccattgtgaacagagagggaaaaatagtaggtctttatggaaatggagtggtgacaacaagtggaacctacgtcagtgccatagctcaagccaaagcatcacaagaagggcctctaccagagattgaggacgaggtgtttaggaaaagaaacttgacaataatggacctacatccaggatcgggaaaaacaagaagataccttccagccatagtccgtgaggctataaaaagaaagctacgcacgctagtcttagctcccacaagagttgtcgcctctgaaatggcagaggcactcaagggaataccaataaggtaccagacaacagcagtgaaaagtgaacacacgggaaaggagatagttgaccttatgtgtcacgccacttttaccatgcgtctcctctcccctgtgagagttcccaattataatatgattatcatggatgaagcacatttcactgatccagccagcatagcagccagagggtatatctcaacccgagtgggtatgggtgaagcagctgcaattttcatgacagccaccccccctggatcgatggaggcctttccacagagcaatgcagctatccaagatgaggaaagagatattcctgaaaggtcttggaactcaggctatgactggattactgatttcccaggaaaaacagtttggtttgttccaagcatcaaatcaggaaatgacattgccaactgtttaagaaagaatgggaaacgggtggtccaattgagcaggaaaacctttgacactgagtaccagaagacaaaaaataacgactgggactatgttgtcacaacagacatatccgaaatgggagcaaacttccgagctgacagggtaatagatccaaggcggtgcctaaaaccggtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccatgcccattggacagaagcaaaaatgctccttgacaacataaacacaccagaagggattatcccagccctctttgagccggagagagaaaagagcgcagcaatagacggggaatacagactacggggtgaagcgaggaaaactttcgtggagcttatgagaagaggagatctacctgtctggctgtcctacaaagttgcttcagaaggcttccagtactccgacagaaggtggtgctttgatggagaaaggaacaaccaggtgctggaggagaacatggatgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgccttggacaacctggttatgctgcacaactctgaacagggaggaaaagcctatagacacgccatggaagaattaccagacactatagaaacattaatgcttctggctttaatagctgtgctgactggtggggtgacgttgttcttcctatcaggaaggggtctaggaaaaacatccattggtctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctactattcatgatattgacagtggcagccaatgagatgggattactggaaaccacaaagaaggacctagggattggtcatgtggctgctgaaagccaccatcatgctgcaatgctggacgtggacctacatccagcttcagcctggaccctctatgcagtggccacaacaattatcactcccatgatgagacacacaattgaaaacacaacggcaaacatttccctgacagctatcgcaaaccaggcagctatattgatgggacttgacaagggatggccaatatcaaagatggacataggagttccccttcttgccttggggtgttactctcaggtgaacccgctgacgctgacagcggcggtgttgatgctagtggctcattatgccataattggacccggactgcaagcaaaagctactagagaagctcaaaaaaggacagcagctggaataatgaaaaacccaactgttgatgggatcgttgcaatagatttggaccctgtggtttacgatgcaaaatttgagaaacagctaggccaaataatgctgttgatactttgcacatcacagattctcctgatgcggaccacatgggccttgtgtgaatccatcacactagccactggacctctgaccacactctgggagggatctccaggaaaattctggaataccacgatagcggtgtccatggcaaacatctttaggggaagctatctagcaggagcaggtctggccttttcattaatgaaatctctaggaggaggtaggagaggcacgggagcccaaggggaaacactgggagaaaaatggaaaagacagctgaaccaactgagtaagtcagaattcaacacctacaaaaggagcgggatcatagaggtggatagatctgaagccaaagaggggttaaaaagaggagaaacgactaaacacgcggtgtcgagaggaacggccaaactgaggtggtttgtagagaggaaccttgtgaaaccagaagggaaagtcatagacctcggttgtggaagaggtggctggtcatattattgcgctgggctgaagaaagtcacagaagtgaaaggatacacgaaaggaggacctgggcatgaggaaccaattccaatggcaacctatggatggaacctagtaaaactatactccgggaaagatgtgttctttacaccacctgagaaatgtgacaccctcttgtgcgatattggtgagtcctctccgaacccaaccatagaagaaggaagaacgttacgagttctaaggatggtggaaccatggcttagaggaaaccaattttgcataaaagttctaaatccctatatgccaagcgtggtagaaactttggagcaaatgcaaagaaaacatggaggaatgctagtgcgaaatccactctcaagaaactccactcatgaaatgtactgggtttcatgtggaacaggaaatattgtgtcagcagtgaacatgacatctagaatgctgctaaatcgattcacaatggctcacaggaagccaacatatgagagagacgtggacttaggcgctggaacaagacatgtggcagtagaaccagaggtggccaacttagatatcattggccagaggatagaaaatataaaaaatgaacacaaatcaacatggcattatgatgaagataatccatacaaaacatgggcctatcatggatcatatgaggtcaaaccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacacgcacaccaaaagcgaagcgaggcacagcacaaattatggaggtgacagctaggtggttatggggttttctctctagaaacaaaaaacccagaatctgcacaagagaggagttcacaagaaaagtcaggtcaaacgcagctattggagcagtgttcgttgatgaaaatcaatggaactcagcaaaagaggcagtggaagatgaacggttctgggaccttgtgcacagagaaagggagcttcacaagcaaggaaaatgtgccacgtgtgtctacaacatgatgggaaagagagagaaaaaattaggagagtttggaaaggcaaaaggaagccgcgcaatatggtacatgtggttgggagcgcgctttttagagtttgaagcccttggtttcatgaatgaagatcattggttcagcagagagaattcactcagtggagtggagggagagggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcaccaacatggaggcccaactaataagacaaatggagtctgagggaatctttttacccagcgaattggaaaccccaaatctagctgaaagagtccttgactggttggaaaaatatggcatcgagaggctgaaaagaatggcaatcagtggagacgactgtgtggtgaaaccaattgatgacagattcgcaacagccttaacagctttgaatgacatgggaaaggtaagaaaagacataccacaatgggaaccctcaaaaggatggaatgattggcaacaagtgcctttctgttcacaccatttccaccagctgattatgaaggatgggagggagatagtggtgccatgccgcaaccaagatgaacttgtgggtagggctagagtatcacaaggcgccggatggagcctgagagaaactgcatgcctaggcaagtcatatgcgcaaatgtggcagctgatgtatttccacaggagagacttgagattagcggctaatgctatctgttcagccgtcccggttgattgggtcccaaccagccgcaccacctggtcgatccatgcccaccaccaatggatgacaacagaagacatgttgtcagtgtggaatagggtttggatagaggaaaacccatggatggaggataaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtga

SEQ ID NO: 6222 - RNA, 9879 nt, synthetic construct
  misc_feature 1..9879: note = derived and/or modified CDS sequence (wt) from DENV-1__KJ438293__SS-prME
  source 1..9879: mol_type = other RNA
tctgtgaccatgctccttatgctgatgcctacagccttggcgttccatttgactacacgagggggagagccgcacatgatcgtcagcaagcaggaaagaggaaagtcacttttgtttaagacctcagcaggtgtcaacatgtgcacccttatagcgatggatttgggagagttatgtgaggatacaatgacttacaaatgccctagaatcactgaggcggaaccagatgacgttgattgttggtgtaatgccacagacacatgggtgacctatggaacatgttcccaaactggcgagcaccgacgagacaaacgttccgtcgcactggccccacatgtgggacttggtttggaaacaagaactgaaacgtggatgtcctctgaaggcgcttggaaacagatacaaagagtggagacttgggccctgagacacccaggattcacggtgatagccctctttctagcacatgccataggaacatccatcacccagaaagggattatcttcattttgttaatgctggttacaccatccatggccatgcgatgcgtgggaataggcagcagggactttgtggaaggactgtcaggagcaacttgggtagatgtggtgctggaacatggaagttgcgtcactaccatggcaaaagacaaaccaacactggacattgaactcttgaagacggaagtcacaaaccctgccatcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttatgacgtgtgctaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaactataacacctcaagctcctacgacggaaatacagctgactgactacggagctcttacattggattgttcacctagaacaggactagactttaatgaaatggtgttgttgacaatgaaagaaaaatcatggctagttcacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaaataagctggttcaaaaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctggtaacgctatacttaggagtcatggttcaggcggattcaggctgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaacccgtctcgagaacatcatgtggaagcaaatatcaaatgaattgaaccacatcttacttgaaaatgacatgaaattcacagtggttgtaggagatgttgctgggatattggctcaagggaagaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattacgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaagaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggtcggagccaacgcttccgacaggatggggatgggaacgacatacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaactattgactggctttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttataacggaaaacaaaatctggggaaggaaaagttggcccctcaatgaaggaatcatggctgttggaatagttagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattgtcaataccagcgaccctttttgtgtggtacttttggcaaaaaaagaaacagagatccggagtgttatgggacacacctagccctccagaagtggaaagagcagttcttgatgatggtatctatagaatcatgcagagaggactgttgggcaggtcccaagtaggggtaggagtctttcaagagaacgtgttccacacaatgtggcatgtcaccaggggagctgtactcatgtatcaagggaagagactagaaccgagctgggccagtgtcaaaaaagacctgatctcatatggaggaggttggaggcttcaaggatcctggaacacgggagaagaagtgcaggtgattgctgttgaaccagggaagaacccaaaaaatgtacaaacagcgccgggcacctttaagacccctgaaggcgaagttggagccattgccctagattttaaacccggcacatctggatctcccatcgtgaacagagaaggaaaaatagtaggtctttatggaaatggagtagtgacaacaagtggaacctacgtcagtgccatagctcaagctaaagcatcacaggaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccgtccagcatagcggctagagggtacatctcaactcgagtgggcatgggtgaagcagctgcgatcttcatgacagccactcccccaggatcagtggaggcctttccacagagcaacgcagttatccaagatgaggaaagagacattcctgagagatcatggaactcaggctatgactggatcactgacttcccaggcaaaacagtttggtttgttccaagcattaaatcaggaaatgatattgccaactgcttaagaaagaatggaaaacgggtgattcaattgagcaggaaaacctttgacacagagtaccaaaaaacaaaaaataacgactgggactacgtcgtcacaacagacatctcagaaatgggagcaaatttccgggccgacagggtgatagacccaagacggtgtttgaaaccggtaatactaaaagatggtccagagcgtgtcgttttagcaggaccgatgccagtgactgtggccagtgccgctcagaggagaggaagaattggaaggaaccacaataaggaaggtgatcagtacatttacatgggacagcctttaaacaacgatgaagatcatgctcattggacggaagcaaaaatgctccttgataatataaacacaccagaagggattatcccagccctcttcgagccggagagagaaaagagtgcagcaatagatggggaatacagactgcggggtgaagcaaggaaaacgtttgtggagctcatgagaagaggagatctacctgtctggctatcctacaaagttgcctcagaaggcttccagtactctgatagaagatggtgttttgacggggaaaggaataaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaacgccttggacaacctggttatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggcctagggaaaacatctatcggcctactctgcgtgatggcttcaagcgtactgctatggatagccagtgtagagccccattggatagcggcctccatcatactggagttcttcctgatggtgctgcttattccagagccagatagacaacgcactccgcaggacaaccagctggcatatgtggtgataggtttgttattcatgatactgacagtagcagccaatgagatgggattgctggaaaccacaaagaaagacttagggattggccatgtggccgttgaaaatcaccaccatgccgcaatactggacgtagacttacatccagcttcagcctggaccctctatgcggtggccacaacaatcatcactcccatgatgaggcacacaatcgaaaacacaacggcaaacatttccctgacagccattgcaaaccaggcagcgatattgatgggacttgacaaaggatggccaatatcaaaaatggacataggagttccacttctcgccttagggtgctattcccaggtaaatccactgacgctgacagcggcggtactgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccagggaaattttggaacaccacgatagcagtttccatggcaaacattttcaggggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggatcatggaagtggacagatccgaagccaaagagggactgaaaaggggagaaacaaccaaacatgcagtgtcgaggggaaccgctaaattgaggtggtttgtggagaggaaccttgtgaaaccagaagggaaagtcatagacctcggttgtggaagaggtggctggtcatactattgcgctgggctgaagaaagtcacagaagtgaaaggatacacaaaaggaggacctggacatgaagaaccaatcccaatggcgacctatggatggaacctagtaaagctgtactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgttagtgcgaaatccactgtcaagaaattctactcatgaaatgtactggatttcatgtggaacaggaaacattgtgtcagcagtaaacatgacatccagaatgttgctaaatcgattcacaatggctcacaggaaaccaacatatgaaagagatgtggacctaggcgccggaacaagacatgtggcagtggaaccagaggtagccaacctagatatcattggccagaggatagagaacataaaacatgaacacaaatcaacatggcattatgatgaggacaatccatataaaacatgggcctatcatggatcatacgaggtcaagccatcaggatcagcctcatccatggtcaatggcgtggtgaaactgctcaccaaaccatgggatgtcatccccatggtcacacagatagccatgactgacactacaccctttggacaacagagggtgttcaaagagaaagttgacacacgcacaccaaaagcaaaacgaggcacagcacaaatcatggaggtgacagccaggtggttatggggttttctttctagaaacaagaagccaagaatttgcacaagagaggagttcacaagaaaagttaggtcaaacgcagccatcggagcagtgttcgttgacgaaaatcaatggaactcagcaaaagaagcagtggaagatgagcggttctgggaccttgtgcatagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgctttctagagttcgaagctcttggcttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaacaaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaattagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacttgagactagccgctaatgctatctgttcagccgttccagttgattgggtcccaaccagccgcaccacctggtcgatccatgcccatcatcaatggatgacaacagaagacatgctgtcagtgtggaatagagtttggatagaggaaaacccatggatggaggacaaaacccatatatccagttgggaagatgttccatatttagggaaaagggaagatcaatggtgtggatccctgataggcttaacagcaagagccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6223 - RNA, 9879 nt, synthetic construct
  misc_feature 1..9879: note = derived and/or modified CDS sequence (wt) from DENV-1__KJ438296__SS-prME
  source 1..9879: mol_type = other RNA
tctgtgaccatgctccttatgctgatgcccacagccttggcgttccatttgactacacgagggggagagccgcacatgatggttagcaagcaggaaagaggaaagtcacttctgtttaagacctcagcaggtgtcaacatgtgcacccttatagcgatggatttgggagagttatgtgaggacacaatgacttacaaatgccctcgaatcactgaggcggaaccagatgatgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacatccaggatttacggtgatagccctctttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaattttgtgtgtcgacgaacgtttgtggatagaggctggggcaatggctgtgggctcttcggaaaaggaagccttataacgtgtgctaagttcaagtgtgtgacaaaattggaaggaaaaatagttcaatatgaaaacttgaaatattcagtaattgtcaccgtccacactggagaccagcaccaagtgggaaatgaaagcacagaacatgggacaactgcaactataacacctcaagctcccacgacggaaatacagctgaccgactacggagctcttacactggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacattcaagacagctcatgcaaagaagcaggaagtagtcgtactaggatcacaagaaggagcaatgcacactgcgttgaccggagcgacagaaatccaaacatctggaacgacaacaatttttgcaggacatttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagattcctttttcgacccaagatgaaaaaggagtaacccagaatgggagattgataacagccaaccccatagttactgacaaagaaaagccagtcaacattgaggcggaaccgccttttggtgagagttacattgtgataggagcaggtgaaaaagctttgaaactaagctggttcaagaaaggaagtagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagtccacacttggacagagcaatacaaatttcaagctgactccccaaagagactatcagcagccattgggaaggcatgggaggagggtgtgtgtggaattcgatcagcaactcgtctcgagaacatcatgtggaagcaaatatcaaatgaattgaaccatatcttacttgaaaatgacatgaaattcacagtggttgtaggagatgttgctgggatcttggctcagggaaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccaccggcttatgtcagctgccatcaaggacagcaaggcagttcacgctgacatggggtactggatagaaagtgaaaagaacgagacctggaagctggcaagagcctctttcatagaagtcaaaacatgtatttggccaaaatcccacactctatggagtaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataatccatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactgggactgctatgcatatcaataatgatcgaagaggtgatgagatccagatggagtagaaaaatgctgatgattggaacattggctgtgttcttccttctcataatgggacagttgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaatcggattgagtctagtggcatctgcggagttaccaaattccttggaggagctgggggacggacttgcaatgggcattatgattttaaaattattgactgactttcaatcacatcagctgtgggctactttgctgtccttgacatttatcaaaacaacgttttccttgcactatgcatggaagacaatggctatggtactgtcaattgtatctctcatccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgtcatatctggaagttcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgttcccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccttaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgccttctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataatgactgggactatgtcgtcacaacagacatctccgaaatgggagcaaatttccgggccgacagggtgatagacccaagacggtgtctgaaaccggtaatactaaaagatggtccagagcgcgtcatcttagcaggaccgatgccagtgactgtggccagtgctgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggagaatacagactgcggggtgaagcaaggaaaacgtttgtggagctcatgagaagaggagatctacctgtctggctatcctacaaagttgcctcggaaggcttccagtactctgatagaagatggtgctttgacggggaaaggaacaaccaggtgttggaggagaacatggatgtggagatctggacaaaagaaggagaaagaaagaaactacgaccccgctggctggatgccagaacatactcagacccactggctttgcgcgagtttaaagagtttgcagcaggaagaagaagcgtctcaggtgatctaatattagaaatagggaaacttccacaacacttgacgcaaagggcccagaatgccttggacaacctggtcatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatccatcggcctactctgcgtgatggcttcaagcgtactgctatggatggccagtgtagagccccattggatagcggcctctatcatactggagttcttcctgatggtgctgcttattccagagccagacagacaacgcactccgcaggacaaccagctggcatatgtggtgataggtttgttattcatgatactgacagtagcagctaatgagatgggactgctggaaaccacaaagaaagacttagggattggccatgtggctgttgaaaaccaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgctgatactatgcacatcacagatcctcttgatgcggactacatgggccttgtgcgaatccatcacgttggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacggctgaaccaactgagcaagtcagaatttaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatattattgcgctgggctgaagaaagtcacagaagtgaagggatatacaaaaggaggacctggacatgaagaaccaatcccaatggcgacctatggatggaacctagtaaagctgcattccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggagggatgctagtgcgaaatccactttcaagaaattccactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacacgtggcagtggaaccagaggtagccaacctagatatcattggccagaggatagagaacataaaacatgaacacaagtcaacatggcattatgatgaggacaatccatacaaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaggagaaagttgatacacgcacaccaaaagcaaaacgaggtacagcacaaatcatggaggtgacagccaggtggttatggggttttctttctagaaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagagagcttcacaaacagggaaaatgtgccacgtgtgtttataacatgatggggaagagagagaaaaagttaggagagtttggaaaggcaaaaggaagtcgtgcaatatggtacatgtggttgggagcacgctttctagagttcgaagctcttggattcatgaacgaagaccactggttcagcagagagaattcactcagtggagtggaaggagaaggactccacaaacttggatacatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacacttttaccaacatggaagcccagttgataagacaaatggagtctgagggaatcttttcacccagtgaattagagaccccaaatttagccgagagagttctagactggctgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctgggtggagcctgagagaaaccgcatgcctaggcaaatcatatgcacaaatgtggcagctgatgtacttccacaggagagacctgagactagccgctaatgccatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccaattgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6224 - RNA, 9879 nt, synthetic construct
  misc_feature 1..9879: note = derived and/or modified CDS sequence (wt) from DENV-1__KC692495__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacacgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagaaagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtctttcaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagataccagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgctatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggctactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6225 - RNA, 9879 nt, synthetic construct
  misc_feature 1..9879: note = derived and/or modified CDS sequence (wt) from DENV-1__KC692496__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactagccccacacgtgggacttggtctagaaacaagaaccgaaacatggatgtcctctgaaggcgcctggagacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagactttgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatactcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctaaaaaatgacgtgccgttggccgggccactactagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgcacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggagacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaacactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgattatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggctaccaacatacaagtagccataaaccaagtgagaaggctcatcgggaatgagaattatttagattacatgacatcaatgaagagattcaagaatgagagtgatcccgaaggagcactctggtaa

SEQ ID NO: 6226 - RNA, 9879 nt, synthetic construct
  misc_feature 1..9879: note = derived and/or modified CDS sequence (wt) from DENV-1__KC692497__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccctttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaagaaggagcaatgcacactgcgttgaccggggcgacagaaatccagacgtcaggaacgacaacaatctttgcaggacacctgaaatgcagattaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggacgggaacaacgtacctagccttgatggctacttttaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacacttactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatttagcaggagcaggtctggctttctcattaatgaaatctttaggaggaggtaggagaggtaccggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaatctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatgtcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggaccttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6227 - RNA, 9879 nt, synthetic construct
  misc_feature 1..9879: note = derived and/or modified CDS sequence (wt) from DENV-1__KC692498__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccctttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggagcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggacgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacacttactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggggaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgacttttcaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggagcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatttagcaggagcaggtctggctttctcattaatgaaatctttaggaggaggtaggagaggtaccggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatgtcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggaccttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6228 - RNA, 9879 nt, synthetic construct
  misc_feature 1..9879: note = derived and/or modified CDS sequence (wt) from DENV-1__KC692499__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgtgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaatacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaagagaaggaggagaatctagtcagatcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctacagaatcttgcaaagaggactgttggggaggtcccaagtaggagtgggagtcttccaagacggcgtgttccacacaatgtggcacgttaccaggggagctgtccttatgtaccaagggaagagattggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattgctgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcgaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaattctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgacaccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggtcaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6229 - RNA, 9879 nt, synthetic construct
  misc_feature 1..9879: note = derived and/or modified CDS sequence (wt) from DENV-1__KC692500__SS-prME
  source 1..9879: mol_type = other RNA
tccgtgaccatgctcctcatgctgctgcccacagccctggcgtttcatttgaccactcgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacattggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaaggaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttcaaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagttcaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgcttattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatatacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatgggttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6230 - RNA, 9879 nt, synthetic construct
  misc_feature 1..9879: note = derived and/or modified CDS sequence (wt) from DENV-1__KC692501__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgctctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgattgtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctcctttatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggaaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactgccagacaccatagaaacattgatgcttctagctttgatagctgtgttgactggtggagtgacgctgttcttcctatcaggaaaaggtctagggaaaacatccattggcttgctctgtgtgacggcctcaagtgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgctataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgccctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6231 - RNA, 9879 nt, synthetic construct
  misc_feature 1..9879: note = derived and/or modified CDS sequence (wt) from DENV-1__KC692502__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcctgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggggaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcacccaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctgttgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaagggggtgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgagacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaggttcttctcctcacgattgggttaagcctggtggcatccgtggagctaccaaattctttggaggagctaggggatggacttgcaatgggtatcatgatgttaaaattgttgactgaatttcagccacaccagttatggaccaccttattgtctctgacatttgtcagaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaaatggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctatgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctttgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataagccaagtgagaaggctcatcgggaatgagaattatttagattacatgacatcaatgaagagattcaagaatgagagtgatcccgaaggagcactctggtaa

SEQ ID NO: 6232 - RNA, 9879 nt, synthetic construct
  misc_feature 1..9879: note = derived and/or modified CDS sequence (wt) from DENV-1__KC692503__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggccacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggatagactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatatgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgattggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcttggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtaaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggaaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagataccttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgctataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgacattggtgagtcctctccgaatccaactatagaagaaggaagaacgttacgtgttctaaaaatggtggaaccatggctcagaggaaaccaattctgcataaaaatcttaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggtttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattacttagattacatgacatcaatgaagagattcaagaatgagagtgatcccgaaggagcactctggtaa

SEQ ID NO: 6233 - RNA, 9879 nt, synthetic construct
  misc_feature 1..9879: note = derived and/or modified CDS sequence (wt) from DENV-1__KC692504__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcatgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagctctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtatttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacactccagaatgtcccgatggccaaagagcatggaacatttgggaagttgaggactatgggtttggagttttcacgacaaacatatggctgaaattgcgtgattcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccctttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcccttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagacccctgaaggcgaagttggagccatagctctagatttcaaacctggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtaggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgttaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcatcccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcagcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacgtcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggctagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6234 - RNA, 9879 nt, synthetic construct
  misc_feature 1..9879: note = derived and/or modified CDS sequence (wt) from DENV-1__KC692508__SS-prME
  source 1..9879: mol_type = other RNA
tccgtgaccatgctcctcatgctgctgcccacagccctggcgtttcatttgaccacacgagggggagagccacacatgatagttagcaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggggaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatattcatggaaaagctggggaaaagctaaaatcataggagcagacatacaaaataccaccttcatcatcgacggcccagacactccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgtacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccctgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcctgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtctacatgggacagcctttaaataatgatgaggaacacgctcattggacagaagcaaaaatgctccttgacaacataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgaaaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggagtttcctttccagaaacaaaaaacccagaatctgcacaagagaggagtttacaagaaaggttcggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaacgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaactcgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6235 - RNA, 9879 nt, synthetic construct
  misc_feature 1..9879: note = derived and/or modified CDS sequence (wt) from DENV-1__KC692509__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcctgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccttttttttagcgcatgctataggaacatccatcacccaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctgttgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaagggggtgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattgggttaagcctggtggcatccgtggagctaccaaattctttggaggagctaggggatggacttgcaatgggtatcatgatgttaaaattgttgactgaatttcagccacaccagttatggaccaccttattgtctctgacatttgtcagaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaaatggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaagaaaactgcgtacgttaatcttggctcccacaagagttgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctttgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataagccaagtgagaaggctcatcgggaatgagaattatttagattacatgacatcaatgaagagattcaagaatgagagtgatcccgaaggagcactctggtaa

SEQ ID NO: 6236 - RNA, 9879 nt, synthetic construct
  misc_feature 1..9879: note = derived and/or modified CDS sequence (wt) from DENV-1__KC692510__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagccttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttaaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacactccagaatgtcccgatggccaaagagcatggaacatttgggaagttgaggactatgggtttggagttttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccacccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttctgacaggatggggatgggaacaacgtacctagccttgatggctacttttaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaagaaaaagttggcccctcaatgaaggaattatggctattggaatagtcagcattctactaagctcactcctcaaaaatgatgtgccgttggccgggccactaatagcaggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagataccttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaacgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagtctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6237 - RNA, 9879 nt, synthetic construct
  misc_feature 1..9879: note = derived and/or modified CDS sequence (wt) from DENV-1__KC692511__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagacgatgttgactgctggtgcaatgccacagacacatgggtgacctatgggacgtgttctcaaaccggcgaacaccgacgagacaaacgttccgtcgcattggccccacacgtgggacttggtctagaaacaagaacagaaacgtggatgtcatctgaaggcgcctggaaacaaatacaaaaagtggagaattgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaataaaccaacattggacattgaactcttgaaaacggaggtcacgaaccctgccgtcctgcgcaaactgtgcattgaagctaaaatatcaaacaccaccaccgattcaagatgtccaacacaaggagaagctacactggtggaagaacaagacgcgaactttgtgtgtcgacggacgttcgtggacagaggctggggtaatggctgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcccatagttactgataaagaaaaaccagtcaacattgagacagaaccaccttttggtgagagctacatcgtggtaggggcaggtgaaaaagctttgaaactaagctggttcaagaaaggaagcagcatagggaaaatgtttgaagcaaccgcccgaggagcacgaaggatggccatcctgggagacactgcatgggacttcggctctataggaggattgttcacgtctgtgggaaaattgatacaccagatttttggaactgcatatggggttctgttcagcggtgtttcttggaccatgaaaataggaatagggattctgttgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatttttgtcaccaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacattaatggaattttggcccaagggaaaaaaatgatcagaccacaacccatggaacacaaatactcatggaaaagttggggaaaagccaagatcataggagcagacatacagaacaccacctttatcattgacggtccagatactccagaatgccccaatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggtggcatccgtggagctgccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaggttggagccatagctctagattttaaacccggcacatctggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaagtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaacaatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtctggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgacaagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggcacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacactacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatcttgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcaaaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaagtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccaccagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggaatgagaattatctagattatatgacatcaatgaagagattcaagaatgagagtgatcccgaaggggcactctggtaa

SEQ ID NO: 6238 - RNA, 9879 nt, synthetic construct
  misc_feature 1..9879: note = derived and/or modified CDS sequence (wt) from DENV-1__KC692512__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccgaatcactgaggcggaaccagatgacgttgactgctggtgcaatgccacagacacatgggtgacctatgggacgtgctctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccctttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgcgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaaaaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagttagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggaaaaaatagtgggtctgtatggaaatggagtggtgacaacaagtggaacctacgtcagtgccattgcccaagctaaagcatcacaggaagggcctctaccagaaattgaggacgaggtgtttaagaaaagaaacttaacaataatggacttgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactgccagacaccatagaaacgttgatgcttctagctttgatagctgtgttgactggtggagtgacgctgttcttcctatcaggaaaaggtctagggaaaacatccatcggcttgctctgtgtgacggcctcaagtgcactgttatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacattctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgctataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctccccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaggtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaaccccaaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6239 - RNA, 9879 nt, synthetic construct
  misc_feature 1..9879: note = derived and/or modified CDS sequence (wt) from DENV-1__KC692513__SS-prME
  source 1..9879: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcatcgaagctaaaatatcaaacaccaccaccgattcaaggtgtccaacacaaggagaagctacactggtggaagaacaagacgcgaactttgtgtgtcgacggacgttcgtggacagaggctggggtaatggttgcggactatttggaaaaggaagtctactgacgtgtgctaagttcaagtgtgtgacaaaactagaaggaaagatagttcaatatgaaaacttaaaatattcagtgatagtcactgtccacactggggaccagcaccaggtaggaaacgagaccacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccataagcaatggtttctagacttaccactgccttggacttcgggagcttcaacaccccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagacgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgtttgaagcaaccgcccgaggagcacgaaggatggccatcctgggagacactgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggtatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacattaatggaattttggcccaagggaaaaaaatgatcagaccacaacccatggaacacaaatactcatggaaaagttggggaaaagccaagatcataggagcagacatacagaacaccacctttatcattgacggtccagatactccagaatgccccgatgaccaaagagcatggaacatctgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatactgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatccagagaagttcttcttctcacggttggattaagcctggtggcatccgtggagctgccaaattctttagaggagctaggggatggacttgcaatgggcatcatgatgttaaaattattgactgacttccagccacaccagttatggactaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcattctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccggaagtggaaagggcagttcttgatgatggcatttatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaactacaacatgattatcatggatgaagcacactttactgatccagccagcatagcagccagagggtacatctcaacccgagtgggtatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccaaaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatctaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctggctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcctccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctggggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaacatttccctgacagccatcgcaaaccaggctgctatattgatggggcttgataagggatggccaatatcgaagatggatataggagtcccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaaatctttaggaggaggtaggagaggcacgggagctcaaggggaaacactgggagaaaaatggaaaagacagctaaaccaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacactacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattgggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccctaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggctcatcgggagtgagaattatctagattatatgacatcaatgaagagattcaagaatgagagtgatcccgaaggggcactctggtaa

SEQ ID NO: 6240 - RNA, 9879 nt, synthetic construct
  misc_feature 1..9879: note = derived and/or modified CDS sequence (wt) from DENV-1__KC692514__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggagacaaatacaaagagtggaaacttgggctttgagacacccaggattcacggtgatagctttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttaaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatccgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaacaccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatcccagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggccatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagctggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggctggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaagatagtgggtctgtatggaaatggagtggtgacaacaagtggaacctacgtcagtgccattgcccaagctaaaacatcacaggaagggcctctaccagagattgaggacgaggtgtttaagaaaagaaacttaacaataatggacctgcacccaggatcagggaaaacaagaagataccttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattatcatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcgggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagaaccagacagacagcgcactccacaggacaaccagttagcatatgtggtgataggtttgttattcatgatactgacagtggcagccaatgagatgggattattggaaaccacaaaaaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtgaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacacggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagatcatggaggtgacagccaagtggttatggggtttcctttctagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaagactcatcgggaatgagaattatttagattacatgacatcaatgaagagattcaagaatgagagtgatcccgaaggagcactctggtaa

SEQ ID NO: 6241 - RNA, 9879 nt, synthetic construct
  misc_feature 1..9879: note = derived and/or modified CDS sequence (wt) from DENV-1__KC692515__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccgaatcactgaggcggaaccagatgacgttgactgctggtgcaatgccacagacacatgggtgacctatgggacgtgctctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagccctttttttagcgcatgctatagggacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgcgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacattggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaaaaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcactggctcatttaagttagagaaggaagtggctgagacccagcatggaactgtcctagtgcaggtcaaatatgaaggaacagacgcgccatgcaagatccccttctcgacccaagatgagaaaggagtgacccagaatgggagattgataacagccaatcccatagttactgacaaagaaaaaccagtcaacattgagacagaaccaccttttggtgagagctacatcgtggtaggggcaggcggaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtggaattcgatcagccacgcgtcttgagaacatcatgtggaagcaaatatcaaatgaattgaaccacattctacttgagaatgacatgaaattcacagtggttgtaggagatgccaacggaattttggcccaaggaaaaaaaatgattaggccacaacctatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagactaacatccagagaagtccttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgttccacacaatgtggcacgttaccaggggagctgtccttatgtaccaagggaagagactggaaccaagctgggccagtgtcaaaaaggacctgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagaggaaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactgccagacaccatagaaacgttgatgcttctagctttgatagctgtgttgactggtggagtgacgctgttcttcctatcaggaaaaggtctagggaaaacatccatcggcttgctctgtgtgacggcctcaagtgcactgctatggatggccagtgtggagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacattctacaatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgctataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaatatcttcaggggaagttatctagcaggagcaggtctggctttctcattaatgaaatctttaggaggaggtaggagaggtacgggagctcaaggggaaacattgggagagaaatggaaaagacagttaaaccaactgagcaagtcagaattcaacacttacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctccccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgctactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaggtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaaccccaaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctggtaa

SEQ ID NO: 6242 - RNA, 9879 nt, synthetic construct
  misc_feature 1..9879: note = derived and/or modified CDS sequence (wt) from DENV-1__KC692516__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacatgtaggacttggtctagaaacaagaaccgaaacatggatgtcctctgaaggcgcctggaaacaaatacaaagagtggagacttgggctttgagacacccaggattcacggtgatagctttttttttagcacatgctataggaacatccatcactcagaaagggatcatcttcatcctgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggcaatggctgcggactattcggaaagggaagtctactgacgtgtgccaagttcaagtgtgtgacaaaactagaaggaaagatagttcaatatgaaaacttaaaatactcagtgatagtcactgtccacactggggaccagcaccaggtgggaaacgagaccacagaacatggaacaattgcaaccataacaccacaagctccgacgtcggaaatacagctgaccgactacggagccctcacattggactgctcacctagaacagggctggactttaatgagatggtgctattgacaatgaaagaaaaatcatggcttgtccacaaacaatggtttctagacttaccactgccatggacctcgggggcttcaacatctcaggagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcattcaagctagagaaggaagtggctgagacccagcatggaactgttctagtgcaggtcaaatacgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaagttggtacaccaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcagactcgggatgtgtaatcaactggaagggcagagaacttaaatgtggaagtggcatttttgtcactaatgaagttcacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaactgaaccacattctacttgaaaatgacatgaaattcacagtggttgtaggagacgctaacggaattttggcccaagggaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggtaagttggaactggattttgacttgtgtgaaggtaccacagttgttgtggatgaacattgtggaaatcgaggtccatctctcagaactacaacagtcacaggaaagataatccatgaatggtgttgcagatcctgcacgctaccccccttacgtttcagaggagaagacggatgttggtatggcatggaaatcagaccagtaaaggagaaggaggagaatctagttaggtcaatggtctctgcagggtcaggagaagtggacaatttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagccaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccttggagctaccaaattctttggaggagctaggggatggacttgcaatgggtatcatgatgttaaaattgttgactgaatttcagccacaccagttatggaccaccttactgtctctgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatttggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagctgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggcctgtgtcaaaaaggacttgatctcatatggaggaggttggaggtttcaaggattatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagcggaacctacgtcagtgccattgcccaagctaaagcatcacaggaagggcctctaccagagatcgaggacgaggtgtttaagaaaagaaacttaacaataatggacctgcacccaggatcagggaaaacaagaagatatcttccagccatagtccgtgaggccataaaaaggaaactgcgtacgttaatcctggctcccacaagagttgtcgcctctgaaatggcagaggcactcaagggaatgccaataagatatcagacgacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgattttccaggcaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgtcattctagccggaccgatgccagtgactgtggccagtgctgcccagaggagaggaagaattggaaggaaccaaaacaaggaaggtgatcagtatgtttatatgggacagcctttaaataatgatgaggatcacgctcattggacagaagcaaaaatgctccttgacaatataaacacaccagaagggatcatcccagccctttttgagccagagagagaaaagagtgcagcaatagatggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggccctgcgcgagtttaaagagtttgcagcaggaagaagaagtgtctcaggtgatctgatattggaaatagggaaacttccacaacatttgacgctaagagcccagaatgccctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtttagggaaaacatccattggcttgctctgtgtgacggcctcaagtgcactgttatggatggccagtgtggagccccattggatagcggcctccatcatactagagttctttttaatggtgctgctcattccagagccagacagacagcgcactccacaggacaaccagctagcatatgtggtgataggcttgttattcatgatacttacagtggcagccaatgagatgggattattggaaaccacaaagaaagacctggggattggccatgtagccgccgaaaaccaccaacatgctacaatgctggacgtagacctacatccagcttcagcctggaccctctatgcagtagccacaacagttatcactcccatgatgagacacacaattgaaaatacaacggcaaacatttccctgacagccattgcaaatcaggcagctatattgatgggacttgacaaaggatggccaatatcgaagatggacataggagttccacttctcgccttagggtgctattcccaggtgaacccattgacgctgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccagataatgttactgatactttgtacatcacagatcctcttgatgcggaccacatgggccttgtgtgaatccatcacactggctactggacccctgactactctctgggagggatctccaggaaaattctggaataccacgatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggagcctatcccaatggcgacctatggatggaacctagtaaagctacactctggaaaagatgtatttttcatgccacctgagaaatgtgacacccttctgtgtgatattggtgagtcctctccaaatccaaccatagaagaaggaagaacgttacgtgttctaaaaatggtggaaccatggctcagaggaaaccaattctgcataaaaatcttaaatccttacatgccaagtgtggtagaaactctggagcaaatgcaaagaaaacatggagggatgctagtgcgaaacccactctcaagaaattctacccatgaaatgtattgggtttcacgcggaacaggaaacattgtgtcggcagtgaacatgacatccagaatgctactgaaccgattcacaatggctcacaggaagccaacatatgaaagagatgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgctgcaataggagcagtgttcgttgacgaaaaacaatggaactcagcaaaagaagcagtggaagacgaaaggttttgggatctcgtgcacagagagagggagcttcataaacagggaaaatgtgccacgtgtgtctacaacatgatggggaagagagagaaaaaactaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaactcggatacatactcagagacatatcaaagattccggggggaaacatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaagggatctttttacccagcgaattggaaacccccaacctagctgagagagttcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagatctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaacgagagtgatcccgaaggagcactctggtaa

SEQ ID NO: 6243 - RNA, 9879 nt, synthetic construct
  misc_feature 1..9879: note = derived and/or modified CDS sequence (wt) from DENV-1__KC692517__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggagtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggccttgagacatccaggattcacggtgatagccctttttttagcacatgctataggaacatccatcacccagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatactcagtgatagttactgtccacactggggaccagcaccaggtgggaaacgagaccatagaacatggaacaattgcaaccataacacctcaagctcctacgtcggaaatacagctgaccgactacggagcccttacattggactgctcacctagaacagggctggactttaatgagatggtgctattaacaatgaaagaaaaatcatggcttgtccacaaacaatggtttctggacttaccactgccatggacttcgggggcttcaacaccccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaagggatgtcatatgtgatgtgcacaggctcatttaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaatcagtcaacattgagacagaaccaccttttggtgagagctacatcgtggtaggggtaggcgaaaaagctttgaaactaagctggttcaagaaaggaagcagtatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcttgggaggagggagtgtgtggaattcgatcagccacgcgtcttgagaacatcatgtggaagcaaatatcaaatgaattgaaccacattctacttgaaaatgacatgaaattcacagtggttgtaggagatgctaacggaattttggcccaaggaaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggttgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagtaaggtcaatggtctctgcagggtcaggagaagtggacagcttctcattgggaatactatgcgtatcaataatgattgaagaggtgatgagatccagatggagtagaaagatgctgatgactggaacattggctgttttcctccttcttataatgggacagctgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgctaaaattgttgactgaatttcagccacaccagttatggaccaccttactgtctttgacatttgtcaaaacaactctctcattggattatgcatggaaaacaacggccatggtattgtctatcgtatctctctttcctttatgcctgtctacgacctcccaaaaaacaacatggcttccggtgctgttaggatcttttggatgcaacccattaaccatgtttcttataacagaaaacaaaatttggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccgaaagtggaaagagcagttcttgatgatggcatctacagaatcttgcaaagaggactgttgggcaggtcccaagtaggagtgggagtcttccaagatggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaatacgggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgaccttatgtgccacgctacttttaccatgcgtctcttatccccagtgagagttcccaattacaacatgattattatggatgaagcacattttaccgatccagccagcatagcggccagaggatacatctcgacccgagtgggtatgggtgaagcagctgcgatctttatgacagccactcccccaggatcggtggaggcctttccacagagcaatgcagtcatccaagatgaggaaagagacattcctgagagatcatggaactcaggctacgactggattactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgatagggtaatagacccaaggcggtgcttgaaaccggtaatattaaaagatggtccagagcgcgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgtttgtggagctcatgagaagaggagatctaccagtttggttatcctacaaagtagcctcagaaggttttcagtactccgacagaaggtggtgctttgatggggaaaggaacaaccaggtgttagaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaattaccagacaccatagaaacattgatgcttttagctttgatagctgtgttgactggtggagtgacgctattcttcctatcaggaaaaggcttagggaaaacatctattggcttactctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggacactctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccagggaaattctggaataccacgatagcagtgtccatggcaaacatcttcaggggaagttatctagcaggagcaggtctggctttttcattaatgaaatctttaggaggaggtaggagaggcacgggagctcaaggggaaacactgggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaaaggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgctacgtgttctaaaaatggtggaaccatggctcagaggaaaccaattctgcataaaaatcctaaatccttacatgccaagtgtggtagaaactctggaacaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacgatggctcacaggaagccaacatatgaaagagacgtggacttaggcgctggaacaagacatgtggcagtggaaccagaggtagccaacctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgtacaccaagagcaaaacgaggcacaacacaaattatggaggtgacagccaagtggttatggggtttcctttccagaaacaaaaaacccagaatctgcacaagagaggagttcacaagaaaggtcaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaagaaattaggagagtttggaaaggcaaaaggaagtcgtgcaatatggtatatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggccacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactagtaagacaaatggagtctgaaggaatctttttacccagcgaattggaaacccccaacctagctgagagagttcttgactggttggaaaaacatggcgtcgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggctagagtatcgcaaggcgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgctcaccaccaatggatgacaacagaagacatgttgtcagtgtggaatagggtttggatagaggaaaacccatggatggaggacaaaacccatgtatccagttgggaagaagttccatacctagggaaaagggaagatcaatggtgtgggtccctgataggcttgacagcgagggctacctgggctactaacatacaagtagccataaaccaagtgagaaggctcatcgggaatgagaattatctagattacatgacatcaatgaagagattcaagaatgagagtgatcctgaaggagcactctggtaa

SEQ ID NO: 6244 - RNA, 9879 nt, synthetic construct
  misc_feature 1..9879: note = derived and/or modified CDS sequence (wt) from DENV-1__KC762649__SS-prME
  source 1..9879: mol_type = other RNA
tctgtgaccatgctccttatgctgatgcctacagctttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagcccttttcctagcacatgccataggagcatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaacttttgaagacggaagtcacaaaccctgccgttctgcgcaaactatgcattgaagctaaaatatcaaacaccaccaccgactcaagatgtccaacacaaggagaagctacactggtggaagaacaagacgcgaactttgtgtgtcgacgaacgtttgtggacagaggctggggcaatggctgtgggctcttcggaaaaggaagccttataacgtgtgctaagttcaagtgtgtgtcaaaactggaaggaaaaatagttcagtatgaaaacttgaaatattcagtaatagtcaccgtccacactggagaccagcatcaggtgggaaatgaaagcacagaacatgggacaactgcaactataacacctcaagctcccacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgtaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaggaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggagatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcatctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcctgtgagagttcccaattacaacatgattatcatggatgaagcacatttcaccgatccatccagcatagcggctagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgctgttgatactatgcacatcacagatcctcttgatgcggactacatgggccttgtgcgaatccatcacactggccactggacccctgaccacgctctgggagggatctccaggaaaattttggaacaccacgatagcggtttccatggcaaacattttcagaggaagttatctagcaggagcaggcctggccttctcattaatgaaatctctaggaggaggtaggagaggcacgggagcccaaggggaaacactgggagagaaatggaaaagacagctaaatcaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagctcagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagattagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6245 - RNA, 9879 nt, synthetic construct
  misc_feature 1..9879: note = derived and/or modified CDS sequence (wt) from DENV-1__KC762625__SS-prME
  source 1..9879: mol_type = other RNA
tctgtgaccatgctccttatgctgatgcctacagctttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagcccttttcctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaacttttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgtcaaaactggaaggaaaaatagttcagtatgaaaacttgaaatattcagtaatagtcaccgtccacactggagaccagcatcaggtgggaaatgaaagcacagaacatgggacaactgcaactataacacctcaagctcccacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaatcatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaggaaaatgctgatgactggaacactggctgtgttcttccttctcataatgggacaattgacatggaatgatctgatcagattatgcatcatggttggagccaacgcttccgacaggatggggatgggaacgacgtacctagctctgatggccactttcaaaatgagaccaatgtttgctgtagggctactattccgcagactaacatccagagaagttcttcttctaacaattggattgagtctagtggcatctgtggagttaccaaattccttggaggagctgggagatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcctatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcctgtgagagttcccaattacaacatgattatcatggatgaagcacatttcaccgatccatccagcatagcggctagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaagaggacagcggccggaataatgaaaaatccaaccgttgatggaatcgttgcaatagatttggaccctgtggtttatgatgcgaaatttgagaaacaactaggccaaataatgctgttgatactatgcacatcacagatcctcttgatgcggactacatgggccttgtgcgaatccatcacactggccactggacccctgaccacgctctgggagggatctccaggaaaattttggaacaccacgatagcggtttccatggcaaacattttcagaggaagttatctagcaggagcaggcctggccttctcattaatgaaatctctaggaggaggtaggagaggcacgggagcccaaggggaaacactgggagagaaatggaaaagacagctgaatcaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagattagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6246 - RNA, 9879 nt, synthetic construct
  misc_feature 1..9879: note = derived and/or modified CDS sequence (wt) from DENV-1__KC762635__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgctggtgcaatgccacagatacatgggtgacctatggaacatgttcccaaactggcgagcaccgacgagacaaacgttccgtcgcactggccccacacgtgggacttggtttggaaacaagaaccgaaacgtggatgtcctccgaaggcgcttggagacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcactgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctgggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacggtcgttgtggatgaacattgtggaaatcgaggaccatctcttaggaccacaacagtcacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggcctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgatccaattgagcagaaaaacctttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagagaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaataggaaaacttccacagcacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcatcggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6247 - RNA, 9879 nt, synthetic construct
  misc_feature 1..9879: note = derived and/or modified CDS sequence (wt) from DENV-1__KC762650__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgctggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggagacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctctcacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacggtcgttgtggatgaacattgtggaaatcgaggaccatctcttaggaccacaacagtcacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggccatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggccgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggcctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgatccaattgagcagaaaaacctttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagagaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaataggaaaacttccacagcacttgacgcaaagggcccagaatgccttggacaacctggttatgttacacaactccgaacaaggaggaagagcctatagacatgcaatagaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataatcggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgccaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattcttcataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatgggggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcatcggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6248 - RNA, 9879 nt, synthetic construct
  misc_feature 1..9879: note = derived and/or modified CDS sequence (wt) from DENV-1__KC762623__SS-prME
  source 1..9879: mol_type = other RNA
tctgtgaccatgctccttatgctgatgcctacagctttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagcccttttcctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaacttttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgtcaaaactggaaggaaaaatagttcagtatgaaaacttgaaatattcagtaatagtcaccgtccacactggagaccagcatcaggtgggaaatgaaagcacagaacatgggacaactgcaactataacacctcaagctcccacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaatcatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaggaaaatgctgatgactggaacactggctgtgttcttccttctcataatgggacaattgacatggaatgatctgatcagattatgcatcatggttggagccaacgcttccgacaggatggggatgggaacgacgtacctagctctgatggccactttcaaaatgagaccaatgtttgctgtagggctactattccgcagactaacatccagagaagttcttcttctaacaattggattgagtctagtggcatctgtggagttaccaaattccttggaggagctgggagatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttttgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcctatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcctgtgagagttcccaattacaacatgattatcatggatgaagcacatttcaccgatccatccagcatagcggctagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggatgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaagaggacagcggccggaataatgaaaaatccaaccgttgatggaatcgttgcaatagatttggaccctgtggtttatgatgcgaaatttgagaaacaactaggccaaataatgctgttgatactatgcacatcacagatcctcttgatgcggactacatgggccttgtgcgaatccatcacactggccactggacccctgaccacgctctgggagggatctccaggaaaattttggaacaccacgatagcggtttccatggcaaacattttcagaggaagttatctagcaggagcaggcctggccttctcattaatgaaatctctaggaggaggtaggagaggcacgggagcccaaggggaaacactgggagagaaatggaaaagacagctgaatcaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagattagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattacctagattacatgacatcaatgaagagattcaagaacgagagtgatcccgaaggggcactctggtga

SEQ ID NO: 6249 - RNA, 9879 nt, synthetic construct
  misc_feature 1..9879: note = derived and/or modified CDS sequence (wt) from DENV-1__KC762632__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgctggtgcaatgctacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggagacagatgcaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacatcaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaactggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgagactcctacacccaggtgtgtgaccaccggctaatgtcagctgccatcaaggacagcaaggcagttcacgctgacatgggatactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtactacggtcgttgtggatgaacattgtggaaatcgaggaccatctcttaggaccacaacagtcacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggcctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaactagaagataccttccagccatagtccgtgaggccataaaaaggaagctgcgcacactaattctggctcccacaagggttgtcgcttcagaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgatccaattgagcagaaaaacctttgatacagagtaccaaaaaacaaaaaataacgactgggattacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagagaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaataggaaaacttccacaacacttgacgcaaagggcccagaatgccttggacaacctggttatgttacacaactccgaacaaggaggaagagcctatagacatgcaatggaagaactgccagataccatagaaacgttgatgctcctagctttgatagctgtgttaactggtggagtgacgctgttcttcctatcaggaaggggcttaggaaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtactgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggaccaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcatcggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaatatacaagtggccataaaccaagtgagaagactaattgggaatgagaattatctagattacatgacatcaatgaagagattcaagaacgagagtgatcccgaaggggcactctggtga

SEQ ID NO: 6250 - RNA, 9879 nt, synthetic construct
  misc_feature 1..9879: note = derived and/or modified CDS sequence (wt) from DENV-1__KC762637__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaagcaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgctctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgaaaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaataccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggttaatgtcagctgccatcaaggacagcaaggctgttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttcgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatccggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgatttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaattgccagacaccattgaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggcaggagaggcacgggagcccaaggggaaacactgggagagaaatggaaaagacagctgaaccaattgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccaggaggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6251 - RNA, 9879 nt, synthetic construct
  misc_feature 1..9879: note = derived and/or modified CDS sequence (wt) from DENV-1__KC762620__SS-prME
  source 1..9879: mol_type = other RNA
tctgtgaccatgctcttcatgctgctgcccacagccctggcgttccatctgaccacccgagggggagagccgcacatgatagttagcaagcaggaaagaggaaagtcacttttgtttaagacctctgcaggtgtcaacatgtgtacccttatcgcaatggatttgggagagttatgtgaggacacaatgacctacaaatgcccccggatcactgaaacggaaccagatgacgttgactgctggtgcaacgccacggagacatgggtgacttatggaacatgttctcaaactggtgaacaccgacgagacaaacgttccgtcgcattggcaccacacgtagggcttggtctagaaacaagaaccgaaacgtggatgtcctctgaaggcgcttggaaacaaatacaaaaagtggagacctgggctctgagacacccaggattcacggtgatagctctttttctagcacatgccataggaacatccatcactcagaaaggaattattttcattttgctgatgctggtaactccatccatggccatgcggtgcgtgggaataggtaacagagacttcgtggaaggactgtcaggagctacgtgggtggatgtggtactggagcatggaagttgcgttactaccatggcaaaagacaaaccaacactggatattgaactcttaaagacggaggtcacaaacccagccgtcctgcgcaaactgtgcattgaagccaaaatatcaaataccaccaccgattcgagatgtccaacacaaggagaagccacgctggtggaagaacaagacacgaactttgtgtgtcgacgaacgttcgtggacagaggctggggcaatggttgtgggctattcggaaaaggcagcttaataacatgtgccaagtttaagtgtgtgacaaaactggaagggaagatagtccaatatgaaaatttaaaatattcagtaatagtcaccgtccacactggagaccagcaccaagttggaaatgagactatagaacatggaacaactgctaccataacacctcaagctcccacgtcggaaatacagctgacagactacggggctctaacactggactgttcacccagaacagggctagactttaatgagatggtgttgttgactatgaaagaaaaatcatggctcgtccacaaacaatggtttctagacttaccgctgccttggacctcaggggcttcaacatcccaagagacttggaatagacaagacttgctggtcacattcaagacagctcatgcaaagaagcaggaagtagttgtactaggatcacaagaaggagcgatgcacactgcgttgactggagcgacagaaatccaaacgtctggaacgacaacaatttttgcaggacacctgaaatgcagactgaaaatggataaactgactctaaagggggtatcatatgtaatgtgcacaggctcattcaagctagaaaaggaagtggctgagacccaacatggaaccgttctagtgcaggttaagtacgaaggaacagatgcaccatgtaagatccccttctcatcccaagatgagaggggagtaatccagaatgggagattgataacagccaaccccatagtcactgacaaagaaaaaccagtcaacattgaggcggagccaccttttggtgagagctacatcgtggtaggagcaggtgaaaaagctttgaaactaagctggttcaagaagggaagcagtataggaaaaatgtttgaagcaactgcccgtggagcacgaaggatggccattctgggagacactgcatgggacttcggttctataggaggagtgttcacgtccgtgggaaaactggtacaccagatttttggaactgcgtatggagttttgttcagcggtgtttcttggaccatgaaaataggaatagggattctactgacatggctaggattaaattcaaggaacacgtccctttcaatgacgtgtatcgcagttggcatggttacactgtacctaggagtcatggttcaggcggattcgggatgtgtaattaactggaaaggcagagaactcaaatgtggaagcggcatttttgtcactaatgaagttcacacctggacagagcaatacaaattccaggccgactccccaaaaagactatcagcagccattgggaaggcatgggaggagggtgtgtgtggaattcgatcagccactcgtctcgagaacatcatgtggaagcaaatatcaaatgaattgaaccacatcttacttgaaaatgacatgaaattcacagtggtcgtaggagacgtcagtgggatcttggcccaaggaaagaaaatgattaggccacaacccatggaacacaaatactcgtggaaaagctggggaaaagccaagatcataggagcagatgtacagaataccaccttcatcatcgatggcccaaacaccccagaatgccctgataaccaaagagcatggaacatctgggaagttgaagactatggatttggagttttcacgacaaacatatggttgaaattgcgtgactcctacactcaagtgtgtgaccaccggctaatgtcagctgctattaaggatagcaaagcagtccatgctgacatggggtactggatagaaagtgaaaagaacgagacttggaagttggaaagagcctcctttatagaagttaagacatgcatctggccaagatctcacactctatggagcaatggagtcctggaaagtgagatgataatcccaaagacatatggaggaccagtatctcagcacaactacagaccaggatatttcacacaaacagcagggccgtggcatttaggcaagttggaactagattttgatttgtgtgaaggtaccacagttgttgtggatgaaaattgtggaaatcgaggaccatctcttagaaccacaacagtcacaggaaagataatccatgaatggtgctgtagatcttgcacgttaccccccctacgtttcaaaggggaagacgggtgctggtacggcatggaaatcagaccagttaaggagaaggaagaaaacctagttaagtcaatggtctctgcagggtcaggagaagtggacagtttttcactaggactgctatgcatatcaataatgatcgaagaggtaatgagatccagatggagcggaaagatgctgatgactggaacattggctgtgttcctccttctcacaatgggacaactgacatggaatgatctgatcaggctatgtatcatggttggagccaatgcttcagacatgatggggatgggaacaacgtacctagctttgatggctactttcagaatgagaccaatgttcgcagtcgggctgttatttcgcagactaacatccagagaagttcttcttcttacagttggattgagcctggcggcatctgtagaactaccaaattccttagaggagctaggggatggacttgcaatgggcatcatgatgttgaaattactgactgattttcagtcacatcagctatgggctaccttgctgtctttaacatttgtcaaaacaactttttcattgcactatgcatggaagacaatggccatgatactatcaattgtatctctcttccctttgtgcctgtccacgacttctcaaaaaacaacatggcttccggtgctgctgggatctcttggatgcaaaccactaaccatgcttcttataacagaaaacaaaatttgggggaggagaagttggcccatcaatgaaggaattatggctattggaatagttagcatcctactaagttcacttctcaaaaatgatgtgccactagctggcccactaatagctggaggcatgctgatagcatgttatgtcatatccggaagctcggccgatttgtcactggagaaagcggctgaggtctcctgggaagatgaagcagaacactctggtgcctcacacaacatactagtagaggtccaagatgacggaaccatgaagataaaggatgaagagagggatgacacactcactattctcctcaaagcaactctgttagcaatctcaggggtatacccaatgtcaataccagcgaccctctttgtgtggtatttttggcagaaaaagaaacagagatcaggagtgctatgggacacacccagccctccagaagtggaaagagcagtccttgacgatggcatttatagaattcttcaaagaggattgctgggcaggtctcaagtaggagtaggagtttttcaagaaggtgtgttccacacaatgtggcacgtcaccaggggagctgtcctcatgtaccaagggaagagattggaaccaagctgggctagtgtcaaaaaagacttgatctcatatggaggaggttggaggtttcaaggatcctggaacacgggagaagaagtgcaggtgattgctgttgaaccggggaagaaccccaaaaatgtacagacaacgccgggcaccttcaagacctctgaaggtgaagttggagccatagctctagacttcaagcccggcacatctggatctcctatcgtgaacagagaggggaaaatagtgggtctttatggaaatggagtggtgacaacaagtggaacctacgtcagtgccatagctcaagccaaagcatcacaagaagggcccctaccagagattgaggacgaggtgtttaggaaaaggaacttaacaataatggacctacatccaggatcagggaagacaagaagataccttccagccatactccgtgaggccataaaaagaaagctgcgcacgctagtcttggcccccacaagagttgtcgcttctgaaatggcagaagcactcaagggaatgccaataaggtatcagacaacagcagtgaaaagtgaacacacgggaaaggagatagttgatcttatgtgtcacgccactttcaccatgcgtctcctgtctcctgtgagagtccccaactataacatgattatcatggatgaagcacatttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcaggaaaacttttgacactgagtaccagaaaacaaaaaataacgactgggactatgttgtcacaacagacatatccgaaatgggagcaaacttccgagccgacagggtaatagacccaaggcggtgcctgaaaccagtaatactaaaagatggtccagagcgcgtcatcctagccggaccgatgccagtgactgtggccagtgccgcccagaggagaggaagaattggaaggaactcaaataaggaaggagatcagtatgtgtacatgggacagcctctaaataatgatgaggaccacgcccattggacagaagcaaaaatgctccttgacaacataaacacaccagaaggaatcattccagccctctttgagccggagagagaaaagagtgcagcaatagacggggaatacagattacggggtgaagcgaggaaaacgttcgtggagctcatgagaagaggagatctacctgtctggctatcctacaaagttgcctcagagggcttccagtactctgacagaaggtggtgctttgatggggaaaggaacaaccaggtgttggaggagaacatggacgtggagatttggacaaaagagggagaaagaaagaaactacgaccccgctggctggatgccagaacatattctgacccactggctctgcgcgagttcaaagagttcgcagcaggaagaagaagcgtctcaggtgatctaatattagaaatagggaaacttccacaacatttaacgcaaaaggcccagaatgctttggacaatctggtcatgctgcacaactctgaacaaggaggaaaagcctacagacacgccatggaagaactaccagacaccatagaaacgttaatgctcctagctttgatagctgtgctgactggtggagtgacgttgttcttcctatcaggaagaggtctaggaaaaacatccattggcctactctgtgtgatggcttcaagtgcattgttatggatggccagtgtggagcctcattggatagcggcctccatcatactggagttctttctgatggtgttgcttattccagagccagacagacagcgcactccacaagacaaccagctagcatacgtggtgataggcttgttattcatgatattgacagtggcagccaatgagatgggattgttggaaaccacaaagaaagacctggggattggtcatgcagcagctgaaaaccaccaccatgctgcaatgctggacgtggacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctactctcaggtgaacccgttgacgctgacagcggcggtattgatgctagtggctcattatgccataattggacctggactgcaggcaaaagctactagagaagctcaaaaaaggacagcagccggaataatgaaaaacccaactgtcgacgggatcgttgcaatagatttggaccctgtagtttatgatgcaaaatttgaaaaacagctaggtcaaataatgttgttgatactttgcacatcacaaattctcctaatgcggaccacatgggccttgtgtgaatccatcacattggccactggacctctgaccacgctttgggagggatctccaggaaaattctggaataccaccatagcggtgtccatggcaaacattttcaggggaagttatctagcaggagcaggtctggccttttcattgatgaaatctctaggaggaggtaggagaggcacaggagcccaaggagaaacgctgggagaaaaatggaaaagacagctaaaccaattgagcaaatcagaatttaatatttacaaaaggagtgggattatggaggtggatagatctgaagccaaagaggggttgaaaagaggagaaacaaccaaacatgcagtgtcgagaggaacggccaaattgaggtggtttgtggagaggaaccttgtgaaaccagaaggtaaagtcattgacctcggttgtggaagaggtggctggtcatattactgcgctgggctgaagaaagtcacagaagtgaaaggatacacgaaaggaggacctggacatgaggaaccagtcccaatggcaacctatggatggaacctagtaaagctacactccgggaaggatgtattctttacaccacctgagaaatgtgacacccttttgtgtgatatcggtgagtcctctccgaacccaaccatagaagaaggaagaacgttacgtgttctaaagatggtggaaccatggctcagaggaaaccaattttgcataaaaattctaaatccctatatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaacatgacatccagaatgctgctaaatcgattcacaatggctcacaggaagccaacatatgaaaaagatgtggacttaggcgctggaacaagacatgtggcagtggaaccagaggtggccaacctagatatcattggccagaggatagagaatataaaaaatgagcacaaatcaacatggcattacgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacagagggtgtttaaagagaaagttgacacacgcacaccaaaagcgaaacgaggcacagcacaaattatggaggtaacagccaagtggttgtggggttttctctctagaaacaaaaaacccagaatctgcacaagagaggagttcacaagaaaagtcagatcaaacgcagctattggagcagtgttcgttgatgaaaatcaatggaactcagcaaaagaggcagtggaagatgaacgattctgggaccttgtgcacagagagagggagcttcataaacaaggaaaatgtgccacgtgtgtctacaacatgatgggaaagagagagaaaaaactaggagagttcggaaaggcaaaaggaagtcgcgcaatatggtacatgtggttgggagcgcgctttttagagtttgaggcccttggtttcatgaatgaagatcattggttcagcagagagaattcactcagtggagtggaaggagaaggactccacaaacttggatacatactcagagacatatcaaagattccagggggaaatttgtatgcagatgacacagccggatgggacacaagaataacagaggatgatcttcagaatgaggccaaaatcactgacatcatggaacccgaacatgccctactggccacgtcaatctttaaactaacctaccaaaacaaggtagtaagggtgcagagaccagcaaaaaatggaaccgtgatggatgtcatatccagacgtgatcagagaggaagtggacaggttggaacctatggcttaaacaccttcactaacatggaggcccaactaataagacaaatggagtctgagggaatcttttcacccagcgaattggaaaccccaaatctagctaaaagagtcctcgactggttggaaaaacatggcatcgagaggctgaaaaggatggcaatcagtggagatgactgtgtggtgaaaccaattgatgacagatttgcaacagccttaacagccttgaatgacatgggaaaggtaagaaaagacataccgcaatgggaaccttcaaaaggatggaacgattggcaacaagtgcccttttgttcacaccatttccaccagctgattatgaaggatgggagggagatagtggtgccatgccgcaaccaagatgaacttataggtagggccagagtctcacaaggcgccggatggagcttaagagaaactgcatgcctaggcaagtcatatgcacaaatgtggcagctgatgtatttccataggagagatctgagactagcggctaatgccatctgttcagccgttccagttgactgggtcccaaccagccgcaccacctggtcgatccatgcccaccatcaatggatgacaacagaagacatgttgtcagtgtggaatagggtttggatagaggaaaacccatggatggaggataaaactcatgtgtccagttgggaagacgttccatacctaggaaaaagggaagatcaatggtgtggatccctaataggcttaacagcacgagccacctgggccagcaacatacaagtggccataaaccaagtgagaaggctcattgggaacgagaattatctagactatatgacatcaatgaagagattcaaaaacgagagtgatcccgaaggggcactctggtaa

SEQ ID NO: 6252 - RNA, 9879 nt, synthetic construct
  misc_feature 1..9879: note = derived and/or modified CDS sequence (wt) from DENV-1__KC762631__SS-prME
  source 1..9879: mol_type = other RNA
tctgtgaccatgctccttatgctgatgcctacagccttggcgttccatttgactacacgagggggagagccgcacatgacagtcagcaagcaggaaagaggaaagtcacttttgtttaagacctcagcaggtgtcaacatgtgcacccttatagcgatggatttgggagagttatgtgaggacacactgacttacaaatgccctcgaattactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggggaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacattcaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaataccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccctttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcacttctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggtagatcccaagtaggggtaggagtttttcaagaaaatttgttccacacaatgtggcatgtcaccaggggagctgtcctcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcaccttcaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaacttaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgattgggactacgtcgtcacaacagacatctctgaaatgggagcaaatttccgggccgacagggtgatagacccaagacggtgtctgaaaccggtaatactgaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagctggaagaagaagcgtctcaggagatctaatattggaaatagggaaacttccacaacacttgacgcaaagggcccagaatgccttggacaacctggttatgttacacaactccgaacaaggaggaagagcctatagacatgcaatggaagaactgccagaaaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggaccacatgggccttgtgcgaatccatcacactggccactggacctctgaccacactctgggagggatctccaggaaaattttggaacaccacgatagcggtttccatggcaaatatcttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaagaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggagcttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattaccgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagatctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccttatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6253 - RNA, 9879 nt, synthetic construct
  misc_feature 1..9879: note = derived and/or modified CDS sequence (wt) from DENV-1__KC762621__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagccctttttctagcacatgccataggaacatccatcacccagaaagggattatcttcattttgttaatgctggtcacaccatccatggccatgcgatgcgtgggaataggtagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctctcacattggattgttcacctaggacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtagctgagacccagcatggaaccgttctagtgcagatcaaatacgaaggaacagatgcaccatgcaagattcctttttcgacccaagatgaaaaaggagtaacccagaatgggagattgataacagccaaccccatagtcaccgataaagaaaaaccagtcaacattgaggcagaaccgccttttggtgagagttacatcgtgataggagcaggtgaaaaagctttaaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagtcatggttcaggcggattcaggatgtgtaattaattggaaaggtagagaactcaaatgtggaagtggcatttttgtcaccaatgaagttcacacctggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaaaataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcttccgacaggatggggatgggaacgacgtacctagctctgatggccacttttaaaatgagaccaatgtttgctgtagggctactattccgcagactaacatccagagaagttcttcttctgacaattggattaagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacccagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagttgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtaggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctctaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaactttgatgctcctagctttgatagctgtgttaactggtggagtgacgctgttcttcctgtcaggaaggggcttaggaaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggctatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgataaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccagataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagcgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtgaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggttaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatgtatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6254 - RNA, 9879 nt, synthetic construct
  misc_feature 1..9879: note = derived and/or modified CDS sequence (wt) from DENV-1__KC762643__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgactgaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcataggaaaaatgtttgaggcaactgccagaggagcacgaaggatggccatactgggagacaccgcatgggactttggttctataggaggagtgctcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagtcatggttcaggcggattcaggatgtgtaattaattggaaaggtagagaactcaaatgtggaagtggcatttttgtcaccaatgaagttcacacctggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaaaataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatccctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacccagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgctctagattttaaacccggcacatctggatctcccatcgtgaacagagaggggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagttgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgttgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctagatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaactttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgataaaggatggccaatatcgaagatggacataggagttccacttctcgccttggggtgctattcccaagtgaatccactgacgctgacagcggcggtgttgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccagataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagcgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggttaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttataagaaaagtcaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaggcccatgtatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6255 - RNA, 9879 nt, synthetic construct
  misc_feature 1..9879: note = derived and/or modified CDS sequence (wt) from DENV-1__KC762651__SS-prME
  source 1..9879: mol_type = other RNA
tctgtgaccatgctcttcatgctgctgcccacagccctggcgttccatctgaccacccgagggggagagccgcacatgatagttagcaagcaggaaagaggaaaatcacttttgtttaagacctctgcaggtgttaacatgtgtacccttatcgcaatggatttgggagagttatgtgaggacacaatgacctacaaatgcccccggatcactgaaacggaaccagatgacgttgactgctggtgcaacgccacggagacatgggtgacttatggaacatgttctcaaactggtgaacaccgacgagacaaacgttccgtcgcattggcaccacacgtagggcttggtttagaaacaagaaccgaaacgtggatgtcctctgaaggcgcttggaaacaaatacaaaaagtggagacctgggctctgagacacccaggattcacggtgatagctctttttctagcacatgccataggaacatccatcactcagaaaggaattattttcattttgctgatgctggtaactccatccatggccatgcggtgcgtgggaataggtaacagagactttgtggaaggactgtcaggagctacgtgggtggatgtggtactggagcatggaagttgcgttactaccatggcaaaagacaaaccaacactggatattgaactcttaaagacggaggtcacaaacccagccgtcctgcgcaaactgtgcattgaagccaaaatatcaaataccaccaccgattcgagatgtccaacacaaggagaagccacgctggtggaagaacaagacacgaactttgtgtgtcgacgaacgttcgtggacagaggctggggcaatggttgtgggctattcggaaaaggcagcttaataacatgtgctaagtttaagtgtgtgacaaaactggaaggaaagatagtccaatatgaaaatttaaaatattcagtaatagtcaccgtccacactggagaccagcaccaagttggaaatgagactacagaacatggaacaactgctaccataacacctcaagctcccacgtcggaaatacagctgacagactacggggctctaacactggactgttcacccagaacagggctagactttaatgagatggtgttgttgactatgaaagaaaaatcatggctcgtccacaaacaatggtttctagacttaccgctgccttggacctcaggggcttcaacatcccaagagacttggaatagacaagacttgctggtcacattcaagacagctcatgcaaagaagcaggaagtagttgtactaggatcacaagaaggagcgatgcacactgcgttgactggagcgacagaaatccaaacgtctggaacgacaacaatttttgcaggacacctgaaatgcagactgaaaatggataaactgactctaaaaggggtatcatatgtaatgtgcacaggctcattcaagctagaaaaggaagtggctgagacccaacatggaaccgttctagtgcaggttaagtacgaaggaacagatgcaccatgtaagatccccttctcatcccaagatgagaggggagtaatccagaatgggagattgataacagccaaccccatagtcactgacaaagaaaaaccagtcaacattgaggcggagccaccttttggtgagagctacatcgtggtaggagcaggtgaaaaagctttgaaactaagctggttcaagaagggaagcagcataggaaaaatgtttgaagcaactgcccgtggagcacgaaggatggccattctgggagacactgcatgggacttcggttctataggaggagtgtttacgtccgtgggaaaactggtacaccagatttttggaactgcgtacggagttttgttcagcggtgtttcttggaccatgaaaataggaatagggattctactgacatggctaggattaaattcaaggagcacgtccctttcaatgacgtgtatcgcagttggcatggttacactgtacctaggagtcatggttcaggcggactcgggatgtgtaattaactggaaaggcagagaactcaaatgtggaagcggcatttttgtcactaatgaagttcacacctggacagagcaatacaaattccaggccgactccccaaaaagactatcagcagccattgggaaggcatgggaggagggtgtgtgtggaattcgatcagccactcgtctcgagaacatcatgtggaagcaaatatcaaatgaattgaaccacatcttacttgaaaatgacatgaaatttacagtggtcgtaggagacgtcagtgggatcttggcccaaggaaagaaaatgattaggccacaacccatggaacacaaatactcgtggaaaagctggggaaaagccaagatcataggagcagatgtacagaataccaccttcatcatcgacggcccaaacaccccagaatgccctgataaccaaagagcatggaacatctgggaagttgaagactatggatttggagttttcacgacaaacatatggttgaaattgcgtgactcctacactcaagtgtgtgaccaccggctaatgtcagctgctattaaggatagcaaagcagtccatgctgacatggggtactggatagaaagtgaaaagaacgagacttggaagttggaaagagcctccttcatagaagttaagacatgcatctggccaagatctcacactctatggagcaatggagtcctggaaagtgagatgataatcccaaagacatatggaggaccagtatctcagcacaactacagaccaggatatttcacacaaacagcagggccgtggcatttaggcaagttggaactagattttaatttgtgtgaaggtaccacagttgttgtggatgaaaattgtggaaaccgaggaccatctcttagaaccacaacagtcacaggaaagataatccatgaatggtgctgtagatcttgcacgttaccccccctacgtttcaaaggggaagacgggtgctggtacggcatggaaatcagaccagttaaggagaaggaagaaaacctagttaagtcaatggtctctgcagggtcaggagaagtggacagtttttcactaggactgctatgcatatcaataatgatcgaagaggtaatgagatccagatggagcggaaagatgctgatgactggaacattggctgtgttcctccttctcacaatgggacaattgacatggaatgatctgatcaggctatgtatcatggttggagccaatgcttcagacatgatggggatgggaacaacgtacctagctttgatggctactttcagaatgagaccaatgttcgcagtcgggctattatttcgcagactaacatccagagaagttcttcttcttacagttggattgagcctggtggcatctgtagaactaccaaattccttagaggagctaggggatggacttgcaatgggcatcatgatgttgaaattactgactgattttcagtcacatcagctatgggctaccttgctgtctttaacatttgtcaaaacagctttttcattgcactatgcatggaagacaatggccatgatactatcaattgtatctctcttccctttgtgcctgtccacgacttctcaaaaaacaacatggcttccggtgctgctgggatctcttggatgcaaaccactaaccatgcttcttataacagaaaacaaaatttgggggaggagaagttggcccctcaatgaaggaattatggctattggaatagttagcatcctactaagttcacttctcaaaaatgatgtgccactagctggcccactaatagctggaggcatgctgatagcatgttacgtcatatccggaagctcggccgatttgtcactggagaaagcggctgaggtctcctgggaagatgaagcagaacactctggtgcctcacacaacatactagtagaggtccaagatgacggaaccatgaagataaaggatgaagagagggatgacacactcactattctcctcaaagcaactctgttagcaatctcaggggtatacccaatgtcaataccagcgaccctctttgtgtggtatttttggcagaaaaagaaacagagatcaggagtgctatgggacacacccagccctccagaagtggaaagagcagtccttgacgatggcatttatagaattcttcaaagaggattgctgggcaggtctcaagtaggagtaggagtttttcaagaaggtgtgttccacacaatgtggcacgtcaccaggggagctgtcctcatgtaccaagggaagagattggaaccaagctgggctagtgtaaaaaaagacttgatctcatatggaggaggttggaggtttcaaggatcctggaacacgggagaagaagtgcaggtgattgctgttgaaccggggaagaaccccaaaaatgtacagacaacgccgggcaccttcaagacctctgaaggtgaagttggagccatagctctagacttcaagcccggcacatctggatctcctattgtgaacagagaggggaaaatagtgggtctttatggaaatggagtggtgacaacaagtggaacctacgtcagtgccatagctcaagccaaagcatcacaagaagggcccctaccagagattgaggacgaggtgtttaggaaaaggaacttaacaataatggacctacatccaggatcagggaagacaagaagataccttccagccatactccgtgaggccataaaaagaaagctgcgcacgctagtcttggcccccacaagagttgtcgcttctgaaatggcagaagcactcaagggaatgccaataaggtatcagacaacagcagtgaaaagtgaacacacgggaaaggagatagttgatcttatgtgtcacgccactttcaccatgcgtctcctgtctcctgtgagagtccccaactataacatgattatcatggatgaagcacacttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgactggatcactgatttcccaggtaaaacagtctggtttgttccaagcatcaaatcaggaaatgacattgccaactgtttaagaaagaatgggaaacgggtggtccaattgagcaggaaaacttttgacactgagtaccagaaaacaaaaaataacgactgggactatgttgtcacaacagacatatccgaaatgggagcaaacttccgagccgacagggtaatagacccaaggcggtgcctgaaaccagtaatactaaaagatggtccagagcgcgtcatcctagccggaccgatgccagtgactgtggccagtgccgcccagaggagaggaagaattggaaggaacccaaataaggaaggtgatcagtatgtgtacatgggacagcctctgaataatgatgaggaccacgcccattggacagaagcaaaaatgctccttgacaacataaacacaccagaaggaatcattccagccctctttgagccggagagagaaaagagtgcagcaatagacggggaatacagattacggggtgaagcgaggaaaacgttcgtggagctcatgagaagaggagatctacctgtctggctatcctacaaagttgcctcagagggcttccagtactctgacagaaggtggtgctttgatggggaaaggaacaaccaggtgttggaggagaacatggacgtggagatttggacaaaagagggagaaagaaagaaactacgaccccgctggctggatgctagaacatattctgacccactggctctgcgcgaattcaaagagttcgcagcaggaagaagaagcgtctcaggtgacctaatattagaaatagggaaacttccacaacatttaacgcaaaaggcccagaatgctttggataatctggtcatgctgcacaactctgaacaaggaggaaaagcctacagacacgccatggaagaactaccagacaccatagaaacgttaatgctcctagctttgatagctgtgctgactggtggagtgacgttgttcttcctatcaggaagaggtctaggaaaaacatccattggcctactctgtgtgatggcctcaagtgcattgttatggatggccagtgtggagcctcattggatagcggcctccatcatactggagttctttctgatggtgttgcttattccagagccagacagacagcgcactccacaagacaaccagctagcatacgtggtgataggcttgttattcatgatattgacagtggcagccaatgagatgggattgttggaaaccacaaagaaagacctggggattggtcatgcagcagctgaaaaccaccaccatgctgcaatgctggacgtggacctacatccagcttcagcctggactctctatgcagtggccacaacaattatcactcccatgatgagacacacaattgaaaacacaacggcaaatatttccctgacagctattgcaaaccaggcagctatattgatgggacttgacaagggatggccaatatcaaagatggacataggagttccacttctcgccttggggtgctactctcaggtgaacccgttgacgctgacagcggcggtattgatgctagtggctcattatgccataattggacctggactgcaggcaaaagctactagagaagctcaaaaaaggacagcagccggaataatgaaaaacccaactgtcgacgggatcgttgcaatagatttggaccctgtagtttatgatgcaaagtttgaaaaacagctaggtcaaataatgttgttgatactttgcacatcacaaattctcctaatgcggaccacatgggccttgtgtgaatccatcacattggccactggacctttgaccacgctttgggagggatctccaggaaaattctggaataccactatagcggtgtccatggcaaacattttcaggggaagttatctagcaggagcaggtctggccttttcattgatgaaatctctaggaggaggtaggagaggcacaggagcccaaggagaaacgctgggagaaaaatggaaaagacagctaaaccaattgagcaaatcagaatttaatatttacaaaaggagtgggattatggaggtggatagatctgaagccaaagaggggttgaaaagaggagaaacaaccaaacatgcagtgtcgagaggaacagccaaattgaggtggtttgtggagaggaaccttgtgaaaccagaaggtaaagtcattgacctcggttgtggaagaggtggctggtcatattactgcgctgggctgaagaaagtcacagaagtgaaaggatacacgaaaggaggacctggacatgaggaaccagtcccaatggcaacctatggatggaacctagtaaagctacactccgggaaggatgtgttctttacaccacctgagaaatgtgacacccttttgtgtgatatcggtgagtcctctccgaacccaaccatagaagaaggaagaacgttacgtgttctaaagatggtggaaccatggctcagaggaaaccaattttgcataaaaattctaaatccctatatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaacatgacatccagaatgctgctgaatcgattcacaatggctcacaggaagccaacatatgaaagagacgtggacttaggcgctggaacaagacatgtggcagtggaaccagaggtggccaacctagatatcattggccagaggatagagaatataaaaaatgagcacaaatcaacatggcattacgatgaggacaatccatacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacagagggtgtttaaagagaaagttgacacgcgcacaccaaaagcgaaacgaggcacagcacaaattatggaggtaacagccaagtggttgtggggttttctctctagaaacaaaaaacccagaatctgcacaagagaggagttcacaagaaaagtcagatcaaacgcagccattggagcagtgttcgttgatgaaaatcaatggaactcagcaaaagaggcagtggaagatgaacgattctgggaccttgtgcacagagagagggagcttcataaacaaggaaaatgtgccacgtgtgtctacaacatgatgggaaagagagagaaaaaactaggagagttcggaaaggcaaaaggaagtcgcgcaatatggtacatgtggttgggagcgcgctttttagagtttgaggcccttggtttcatgaatgaagatcattggttcagcagagagaattcactcagcggagtggaaggagaaggactccacaaacttggatacatactcagagacatatcaaagattccagggggaaatttgtatgcagatgacacagccggatgggacacaagaataacagaggatgatcttcagaatgaggccaaaatcactgacatcatggaacctgaacatgccctactggctacgtcaatctttaaactaacctaccaaaacaaggtagtaagggtgcagagaccagcaaaaaatggaaccgtgatggatgtcatatccagacgtgatcagagaggaagtggacaggttggaacctatggcttaaacaccttcactaacatggaggcccaactaataagacaaatggagtctgagggaatcttttcacccagcgaattggaaaccccaaatctagctaaaagagtcctcgactggttggaaaaacatggcatcgagaggctgaaaaggatggcaatcagtggagatgactgtgtggtgaaaccaattgatgacagatttgcaacagccttaacagccttgaatgacatgggaaaggtaagaaaagacataccgcaatgggaaccttcaaaaggatggaacgattggcaacaagtgcctttttgttcacaccatttccaccagctgattatgaaggatgggagggagatagtggtgccatgccgcaaccaagatgaactcataggtagggccagagtctcacaaggcgctggatggagcttaagagaaactgcatgcctaggcaagtcatatgcacaaatgtggcagctgatgtatttccataggagagatctgagactagcggctaatgccatctgttcagccgttccagttgactgggtcccaaccagccgcaccacctggtcgatccatgcccaccatcaatggatgacaacagaagacatgttgtcagtgtggaatagggtttggatagaggaaaacccatggatggaggataaaactcatgtgtccagttgggaagacgttccatacctaggaaaaagggaagatcaatggtgtggatccctaataggcttaacagcacgagccacctgggccagcaacatacaagtggccataaaccaggtgagaaggctcattgggaacgagaattatctagactatatgacatcaatgaagagattcaaaaacgagagtgatcccgaaggggcactctggtga

SEQ ID NO: 6256 - RNA, 9879 nt, synthetic construct
  misc_feature 1..9879: note = derived and/or modified CDS sequence (wt) from DENV-1__KC762653__SS-prME
  source 1..9879: mol_type = other RNA
tctgtgaccatgctcctcatgctgctgcccacagccctggcgttccatctgaccacccgaggaggagagccgcacatgatagtcagcaagcaagaaagaggaaaatcacttttgttcaagacctctgcaggtgtcaacatgtgtacccttattgcaatggatttgggagagttatgtgaagacacaatgacctacaaatgcccccggatcactgagacggaaccagatgacgttgactgttggtgcaatgccacggagacatgggtgacctatggaacatgttaccaaactggtgaacaccgacgagacaaacgttccgtcgcattggcaccacacgtagggcttggtctagaaacaagaaccgaaacgtggatgtcctctgaaggcgcttggagacaaatacaaaaagtggagacttgggctctaagacacccaggattcacggtgatagccctttttctagcacatgctataggaacatccatcacccagaaagggattatttttattttgctgatgctggtaactccatccatggccatgcggtgcgtgggaataggcaacagagacttcgtggaaggactctcaggagctacgtgggtggatgtggtgctggagcatggaagttgcgtcactaccatggcaaaagacaaaccaacactggacattgaactcctgaagacggaggtcacaaaccctgcagtcctgcgcaaattgtgcattgaagctaaaatatcaaacaccaccaccgattcgagatgtccaacacaaggagaagccacgctggtggaagagcaggacacgaattttgtgtgccgacgaacgttcgtggacagaggctggggcaatggttgtgggctattcggaaaaggtagcttaataacgtgtgctaagtttaagtgtgtgacaaaactagaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacagggttagactttaatgagatggtgttgttgacaatgaaagaaaaatcatggctcgtccacaaacaatggtttctagacttaccactgccttggacctcgggggcttcaacatcccaagagacttggaacagacaagacttgctggtcacatttaagacagctcatgcaaaaaagcaggaagtagtcgtactaggatcacaagaaggagcaatgcacactgcgctaactggagcgacagaaatccaaacgtctggaacgacaacaattttcgcaggacacctgaaatgcagactaaaaatggataaactgaccttaaaagggatgtcatatgtaatgtgcacagggtcattcaagctagagaaggaagtggctgagactcagcatggaactgttctagtgcaggtcaaatacgaaggaacagatgcaccatgcaagatccccttctcgtcccaagatgagaagggagtgacccagaatgggagattgataacagccaaccccatagtcactgacaaagaaaaaccagttaacattgaagcggagccaccttttggtgagagctaccttgtggtaggagcaggtgaaaaagctttgaaactaagctggttcaagaagggaagcagtataggaaagatgtttgaagcaaccgctcgtggagcacgaaggatggccatcctgggagacaccgcatgggacttcggttctataggaggggtgtttacgtctgtgggaaaattgatacaccagatttttgggactgcgtatggagttttgttcagcggggtttcttggactatgaaaataggaatagggattctgctgacatggctaggattaaattcaaggagcacgtccctttcaatgacgtgtatcgcagttggcatgatcacactgtacctaggagtcatggttcaggcggactcgggatgtgtaatcaactggaaaggcagagaactcaaatgtggaagcggcatctttgtcaccaatgaagtccacacctggacagagcaatacaaattccaagctgactcccccaagagactatcagcggccattgggaaggcatgggaggagggtgtgtgtggaatccgatcagccactcgccttgaaaacattatgtggaagcaaatatcaaatgaactaaaccacatcttacttgaaaatgacatgaaatttacagtggtcgtaggagaagttaatggaatcttggcccaaggaaagaaaatgattaggccacaacccatggaacacaaatattcgtggaaaagctggggaaaagccaaagtcataggagcagatgtacagaataccaccttcatcatcgacggcccaaacaccccagaatgccctgataatcaaagagcatggaacatctgggaagtcgaagactacggatttggaattttcacgacaaacatatggttgaaactgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccataccctatggagcaatggagtcctggaaagtgaaatgataatcccaaaaatatatggaggaccaatatctcagcacaactacagaccaggatatttcacacaaacagcagggccgtggcacttgggcaagttagaactggattttgagttgtgtgaaggtaccaccgttgttgtggatgaacattgtggaaatcgaggaccatctcttagaaccacaacagtcacaggaaagataatccatgaatggtgctgcagatcttgcacgttaccccccctacgtttcaaaggagaagacgggtgctggtacggtatggaaatcagaccagtcaaggagaaggaagagaacctagtcaaatcaatggtctctgcagggtcaggagaagtggacagtttttcactaggactgctatgcatatcaataatgatcgaggaggtaatgagatccagatggagtagaaaaatgctgatgactggaacattggctgtgttcctccttcttacaatgggacaattgacatggaatgatttgatcaggctatgtatcatggttggagccaatgcttcagacaagatggggatgggaacaacgtacctagctttgatggccactttcagaatgagaccaatgctcgcagtcgggctactgtttcgcagattaacgtctagagaagttcttcttctcacagttggattgagtctagtggcatctgtagaactaccaaattccttggaggagctaggggatggacttgcaatgggcatcatgatgttgaaattactaactgactttcagtcacaccagctatgggctgccttgctgtctctaacatttgtcaaaacaactttatcattgcattacgcatggaagacaatggctatgatactgtcaattgtatctctcttccctctatgcctgtccacgacctctcaaaaaacaacatggctcccggtgttgctgggatctcttggatgcaaaccactaaccatgtttcttataacagaaaacaaaatctggggaaggaaaagttggcctctcaatgagggaattatggctgttggaatagttagtattcttttaagctcactcctcaaaaatgatgtgccactagcaggcccactaatagctggaggcatgctaatagcatgttatgtcatatctggaagctcggccgatttatcattggagaaagcggctgaggtctcctgggaagaagaagcagaacactctggtgcctcacacaacatactagtggaggtccaagatgatggaaccatgaagataaaggatgaagagagagatgacacacttaccattctcctcaaagcaactttgctagcaatctcaggggtctacccaatgtcaataccggcgaccctctttgtgtggtacttttggcagaaaaagaaacagagatcaggagtgctatgggacacacccagccctccagaagtggaaaaagcagtccttgatgatggcatttatagaattctccaaagaggactgttgggcaagtctcaagtaggagtaggagtttttcaagaaggtgtgtttcacacaatgtggcacgtcactaggggagctgtcctcatgtatcaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaacgtgcagacagcgccgggtacctttaagactcctgaaggcgaagttggagctatagctctagactttaaacccggcacatctggatctcctattgtgaacagggagggaaaaatagtaggtctttatggaaatggagtggtgacaacaagtggaacctacgtcagtgccatagctcaagccaaagcatcacaagaaggacctctaccagagattgaggacgaggtgtttaggaaaagaaacttaacaataatggacctacacccaggatcgggaaaaacaagaagataccttccagccatagtccgtgaggctataaaaagaaagttacgcacgctagtcttagctcccacaagagttgtcgcctctgaaatggcagaggcgctcaagggaatgccaataaggtaccagacaacagcagtgaaaagtgaacacacgggaaaggagatagttgaccttatgtgtcacgccacttttaccatgcgtctcctttcccctgtgagagttcccaattataatatgattatcatggatgaagcacatttcactgatccagccagcatagcagccagagggtatatctcaacccgagtgggtatgggtgaagcagctgcaattttcatgacagccactccccccggatcgatggaggcctttccacagagcaatgcagctatccaagatgaggaaagagacattcctgaaaggtcatggaactcaggctatgactggattaccgattttccaggcaaaacagtttggtttgttccaagcatcaaatcaggaaatgatattgccaactgtttaagaaagaatgggaaacgggtaatccaattgagcagaaaaaccttcgacactgagtaccagaagacaaaaaataacgactgggactatgttgtcacaacagacatatccgaaatgggagcaaacttccgagcagacagggtaatagacccgaggcggtgcctgaaaccagtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaactttcgtggagcttatgagaagaggagatctacctgtctggctatcctacaaagttgcctcagaaggcttccagtactccgacagaaggtggtgctttgatggagaaaggaacaaccaggtgctggaggagaatatggacgtggagatctggacaaaagaaggagaaagaaagaaactacggccccgctggctggatgccagaacatactctgacccactggctctgcgcgaattcaaagagttcgcagcgggaagaagaagcgtctcaggtgacctaatattagaaatagggaaacttccacaacatttaacgcaaagggcccagaatgccttggacaatctggtcatgctgcacaactctgaacagggaggaaaagcctatagacacgccatggaagaactaccagacaccatagaaacgttaatgcttctggctttgatagctgtgctgactggtggggtgacgctgttcttcctatcaggaaggggtctaggaaaaacatccattggcctactctgcgtgatggcctcaagtgcactgttatggatggccagtgtggaaccccattggatagcggcctctatcatactggagttctttttgatggtgttgcttattccagaaccggacagacagcgcactccacaagacaaccagctagcatacgtggtgataggtctattattcatgatactgacagtggcagccaatgagatgggattactggaaaccacaaagaaggacctagggattggtcatgcagctgctgaaaaccaccatcatgctgcaatgctggacgtagacctacatccagcttcagcctggaccctctatgcagtggccacaacaattattactcccatgatgagacacacaatcgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgttagtggctcattacgccataattggacccggattgcaagcaaaagctactagagaagctcaaaaaaggacagcagctggaataatgaaaaacccaactgttgatgggatcgttgcaatagatttggaccctgtagtttacgatgcaaaatttgaaaaacagctaggtcaaataatgctgttaatactctgcacatcacagatcctcctgatgcggaccacatgggccttgtgtgaatccatcacactagccactggacctctgaccacactctgggagggatctccaggaaaattctggaacaccacgatagcggtgtccatggcaaacatttttaggggaagttatctagcaggagcaggtctggccttttcattaatgaaatctctaggaggaggtaggagaggtacgggagctcaaggggaaacactgggagaaaaatggaaaagacagctaaaccaattgagcaagtcagaattcaacacttacaaaaggagtgggatcatggaggtggacagatctgaagccaaagaggggttgaaaagaggagaaacgactaaacacgcggtgtcgagaggaacggccaaactgaggtggtttgtggagagaaaccttgtgaaaccagagggaaaagtcatagacctcggttgtggaagaggtggctggtcatactattgcgctgggttgaagaaagtcacagaagtgaaaggatacacgaaaggaggacctgggcatgaagaaccaattccaatggcaacctatggatggaacctagtaaagctacactccgggaaagatgtattctttacaccacctgagaaatgtgacactctcttgtgtgatattggtgagtcctctccgaacccaaccatagaagaaggaagaacattacgtgttctaaagatggtggaaccatggctcagaggaaaccaattttgcataaaagttctaaatccctatatgccgagtgtgatagaaactttggagcagatgcagagaaaacatggaggaatgctagtgcgaaatccactctcaagaaactccactcatgaaatgtactgggtttcatgtggaacaggcaatattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggataatccatacaaaacatgggcctatcatggatcatatgaggtcaagccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacgcgcacaccaaaagcgaaacgaggcacagcacaaattatggaggtgacagctaggtggttatggggttttctctctagaaacaaaaaacccagaatctgcacaagagaggaatttacaagaaaagtcaggtcaaacgcagctatcggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaactaggagagttcggaaaggcaaaaggaagccgcgcaatatggtacatgtggttgggagcgcgctttttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgctctattggccacgtcaatcttcaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatctttacacccagcgaattggaaaccccaaatctagccgaaagagttctcgactggttggaaaaacatggcatcgagaggctgaaaagaatggcaatcagtggagatgactgtgtggtgaaaccaattgatgacagattcgcaacagcattaacagctttgaatgacatgggaaaggtaagaaaagacataccgcaatgggaaccctcaaaaggatggaatgattggcaacaagtgcctttctgttcgcaccatttccaccaactgattatgaaggatgggagggagatagtggtgccatgccgcaaccaagatgaacttgtgggtagggccagagtatcacaaggcgctggatggagcctgagagaaactgcatgcctaggcaagtcatatgcacaaatgtggcagctgatgtacttccacaggagagacttgagattagcagctaatgctatctgttcagccgttccagttgattgggtcccaaccagccgtaccacctggtcgatccatgcccaccaccaatggatgacaacagaagacatgttatcagtgtggaatagggtttggatagaggaaaacccatggatggaggacaaaactcacgtgtccagttgggaagacgttccatacctaggaaaaagggaagatcaatggtgtggatccctaataggcttgacagcgcgagccacctgggccactaacatacaagtggccataaaccaagtgagaaggctcattgggaatgagaattatctagattacatgacatcaatgaagagattcaaaaacgagagtgatcccgaaggggcactctggtaa

SEQ ID NO: 6257 - RNA, 9879 nt, synthetic construct
  misc_feature 1..9879: note = derived and/or modified CDS sequence (wt) from DENV-1__KC762640__SS-prME
  source 1..9879: mol_type = other RNA
tctgtgaccatgctcctcatgctgctgcccacagccctggcgttccatctgaccacccgaggaggagagccgcacatgatagtcagcaagcaagaaagaggaaaatcacttttgttcaagacctctgcaggtgtcaacatgtgtacccttattgcaatggatttgggagagttatgtgaagacacaatgacctacaaatgcccccggatcactgagacggaaccagatgacgttgactgttggtgcaatgccacggagacatgggtgacctatggaacatgttcccaaactggtgaacaccgacgagacaaacgttccgtcgcattggcaccacacgtagggcttggtctagaaacaagaaccgaaacgtggatgtcctctgaaggcgcttggagacaaatacaaaaagtggagacttgggctctaagacacccaggattcacggtgatagccctttttctagcacatgctataggaacatccatcacccagaaagggattatttttattttgctgatgctggtaactccatccatggccatgcggtgcgtgggaataggcaacagagacttcgtggaaggactctcaggagctacgtgggtggatgtggtgctggagcatggaagttgcgtcactaccatggcaaaagacaaaccaacactggacattgaactcctgaagacggaggtcacaaatcctgcagtcctgcgcaaattgtgcattgaagctaaaatatcaaacaccaccaccgattcgagatgtccaacacaaggagaagccacgctggtggaagagcaggacacgaattttgtgtgccgacggacgttcgtggacagaggctggggcaatggttgtgggctattcggaaaaggtagcttaataacgtgtgctaagtttaagtgtgtgacaaaactagaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacagggttagactttaatgagatggtgttgttgacaatgaaagaaaaatcatggctcgtccacaaacaatggtttctagacttaccactgccttggacctcgggggcttcaacatcccaagagacttggaacagacaagacttgctggtcacatttaagacagctcatgcaaaaaagcaggaagtagtcgtactaggatcacaagaaggagcaatgcacactgcgctaactggagcgacagaaatccaaacgtctggaacgacaacaattttcgcaggacacctgaaatgcagactaaaaatggataaactgaccttaaaaggggtgtcatatgtaatgtgcacagggtcattcaagctagagaaggaagtggctgagactcagcatggaactgttctagtgcaggtcaaatatgaaggaacagatgcaccatgcaagatccccttctcgtctcaagatgagaagggagtgacccagaatgggagattgataacagccaaccccatagtcactgacaaagaaaaaccagttaacattgaagcggagccaccttttggtgagagctaccttgtggtaggagcaggtgaaaaagctttgaaactaagctggttcaagaagggaagcagtataggaaagatgtttgaagcaaccgctcgtggagcacgaaggatggccatcctgggagacaccgcatgggacttcggttctataggaggggtgtttacgtctgtgggaaaattgatacaccagatttttgggactgcgtatggagttttgttcagcggggtttcttggactatgaaaataggaatagggattctgctgacatggctaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatctttgtcaccaatgaagtccacacctggacagagcaatacaaattccaagctgactcccccaagagactatcagcggccattgggaaggcatgggaggagggtgtgtgtggaatccgatcagccactcgcctcgaaaacattatgtggaagcaaatatcaaatgaactaaaccacatcttacttgaaaatgacatgaaatttacagtggtcgtaggagaagttaatggaatcttggcccaaggaaagaaaatgattaggccacaacccatggaacacaaatattcgtggaaaagctggggaaaagccaaagtcataggagcagatgtacagaataccaccttcatcatcgacggcccaaacaccccagaatgccctgataatcaaagagcatggaacatctgggaagtcgaagactatggatttggaattttcacgacaaacatatggttgaaactgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccataccctatggagcaatggagtcctggaaagtgaaatgataatcccaaaaatatatggaggaccaatatctcagcacaactacagaccaggatatttcacacaaacagcagggccgtggcacttgggcaagttagaactggattttgagttgtgtgaaggtaccaccgttgtcgtggatgaacattgtggaaatcgaggaccatctcttagaaccacaacagtcacaggaaagataatccatgaatggtgctgcagatcttgcacgttaccccccctacgtttcaaaggagaagacgggtgctggtacggtatggaaatcagaccagtcaaggagaaggaagagaacttagttaaatcaatggtctctgcagggtcaggagaagtggacagtttttcactaggactgctatgcatatcaataatgatcgaagaggtaatgagatccagatggagtagaaaaatgctgatgactggaacattggctgtgttcctccttcttacaatgggacaattgacatggaatgatctgatcaggctatgtatcatggttggagccaatgcttcagacaagatggggatgggaacaacgtacctagctttgatggccactttcagaatgagaccaatgttcgcagtcgggctactgtttcgcagattaacgtctagagaagttcttcttctcacagttggattgagtctagtggcatctgtagaactaccaaattccttggaggagctaggggatggacttgcaatgggcatcatgatgttgaaattactaactgattttcagtcacaccagctatgggctgccttgctgtctctaacatttgtcaaaacaactttatcattgcattacgcatggaagacaatggctatgatactgtcaattgtatctctcttccctctatgcctgtccacgacttctcaaaaaacaacatggctcccggtgttgctgggatctcttggatgcaaaccactaaccatgtttcttataacagaaaacaaaatctggggaaggaaaagttggcctctcaatgagggaattatggctgttggaatagttagtattcttttaagctcactcctcaaaaatgatgtgccactagcaggcccactaatagctggaggcatgctaatagcatgttatgtcatatctggaagctcggccgatttatcattggagaaagcggctgaggtctcctgggaagaagaagcagaacactctggtgcctcacacaacatactagtggaggtccaagatgatggaaccatgaagataaaggatgaagagagagatgacacacttaccattctcctcaaagcaactttgctagcaatctcaggggtgtacccaatgtcaataccggcgaccctctttgtgtggtacttttggcagaaaaagaaacagagatcaggagtgctatgggacacacccagccctccagaagtggaaaaagcagtccttgatgatggcatttatagaattctccaaagaggactgttgggcaagtctcaagtaggagtaggagtttttcaagaaggtgtgtttcacacaatgtggcacgtcactaggggagctgtcctcatgtatcaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaacgtgcagacagcgccgggtacctttaagactcctgaaggcgaagttggagctatagctctagactttaaacccggcacatctggatctcctattgtgaacagggagggaaaaatagtaggtctttatggaaatggagtggtgacaacaagtggaacctacgtcagtgccatagctcaagccaaagcatcacaagaaggacctctaccagagattgaggacgaggtgtttaggaaaagaaacttaacaataatggacttacacccaggatcgggaaaaacaagaagataccttccagccatagtccgtgaggctataaaaagaaagttacgcacgctagtcttagctcccacaagagttgtcgcctctgaaatggcagaggcgctcaagggaatgccaataaggtaccagacaacagcagtgaaaagtgaacacacgggaaaggagatagttgaccttatgtgtcacgccacttttaccatgcgtctcctttcccctgtgagagttcccaattataatatgattatcatggatgaagcacatttcactgatccagccagcatagcagccagagggtatatctcaacccgagtgggtatgggtgaagcagctgcaattttcatgacagccactccccccggatcgatggaggcctttccacagagcaatgcagctatccaagatgaggaaagagacattcctgaaaggtcatggaactcaggctatgactggattaccgattttccaggtaaaacagtttggtttgttccaagcatcaaatcaggaaatgatattgccaactgtttaagaaagaatgggaaacgggtgatccaattgagcagaaaaaccttcgacactgagtaccagaagacaaaaaataacgactgggactatgttgtcacaacagacatatccgaaatgggagcaaacttcagagcagacagggtaatagacccgaggcggtgcctgaaaccagtaatactaaaagatggcccagagcgtgtcattctagccggaccgatgccagtgactgtggctagcgccgcccagaggagaggaagaattggaaggaaccaaaataaggaaggtgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaactttcgtggagcttatgagaagaggagatctacctgtctggctatcctacaaagttgcctcagaaggcttccagtactccgacagaaggtggtgctttgatggagaaaggaacaaccaggtgctggaggagaacatggacgtggagatctggacaaaagaaggagaaagaaagaaactacggccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgccttggacaatctggttatgctgcacaactctgaacagggaggaaaagcctatagacacgccatggaagaactaccagacaccatagaaacgttaatgcttctggctttgatagctgtgctgactggtggggtgacgctgttcttcctatcaggaaggggtctaggaaaaacatccattggcctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatactgacagtggcagccaatgagatgggattactggaaaccacaaagaaggacctagggattggtcatgcagctgctgaaaatcaccatcatgctgcaatgctggacgtagacctacatccagcttcagcctggaccctctatgcagtggccacaacaattattactcccatgatgagacacacaatcgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgctagtggctcattacgccataattggacccggattgcaagcaaaagctactagagaagctcaaaaaaggacagcagctggaataatgaaaaacccaactgttgatgggatcgttgcaatagatttggaccctgtagtttacgatgcaaaatttgaaaaacagctaggccaaataatgctgttaatactctgcacatcacagatcctcctgatgcggaccacatgggccttgtgtgaatccatcacactagccactggacctctgaccacactctgggagggatctccaggaaaattctggaacaccacgatagcggtgtccatggcaaacatttttaggggaagttatctagcaggagcaggtctggccttttcactaatgaaatctctaggaggaggtaggagaggtacgggagctcaaggggaaacactgggagaaaaatggaaaagacagctaaaccaattgagcaagtcagaattcaacacttacaaaaggagtgggatcatggaggtggacagatctgaagccaaagaggggttgaaaagaggagaaacgactaaacacgcggtgtcgagaggaacggccaaactgaggtggttcgtagagagaaaccttgtgaaaccagagggaaaagtcatagacctcggttgtggaagaggtggctggtcatactattgcgctgggctgaagaaagtcacagaagtgaaaggatacacgaaaggaggacctgggcatgaagaaccaattccaatggcaacctatggatggaacttagtaaagctatactccgggaaagatgtattctttacaccacctgagaaatgtgacactctcttgtgtgatattggtgagtcctctccgaacccaaccatagaagaaggaagaacattacgtgttctaaggatggtggaaccatggctcagaggaaaccaattttgcataaaagttctaaatccctacatgccgagtgtgatagaaactttggagcagatgcagagaaaacatggaggaatgctagtgcgaaatccactctcaagaaactccactcatgaaatgtactgggtttcatgtggaacaggcaatattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagaaatcattggccagaggatagagaatataaaaaatgaacacaaatcaacatggcattatgatgaggataatccatacaaaacatgggcctatcatggatcatatgaggtcaagccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacgcgcacaccaaaagcgaaacgaggcacagcacaaattatggaggtgacagctaggtggttatggggttttctctctagaaacaaaaaacccagaatctgcacaagagaggaattcacaagaaaagtcaggtcaaacgcagctatcggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaactaggagagttcggaaaggcaaaaggaagccgcgcaatatggtacatgtggttgggagcgcgcttcttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgctctattggccacgtcaatctttaagctaacctaccaaaacaaggtggtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatctttacacccagcgaattggaaaccccaaatctagccgaaagagttctcgactggttggaaaaacatggcatcgagaggctgaaaagaatggcaatcagtggagatgactgtgtggtgaaaccaattgatgacagattcgcaacagcattaacagctttgaatgacatgggaaaggtaagaaaagacataccgcaatgggaaccctcaaaaggatggaatgattggcaacaagtgcctttctgttcacaccattttcaccaactgattatgaaggatgggagggagatagtggtgccatgccgcaaccaagatgaacttgtgggtagggccagagtatcacaaggtgctggatggagcctgagagaaactgcatgcctaggcaagtcatatgcacaaatgtggcagctgatgtacttccacaggagagacttgagattagcagctaatgctatctgttcagccgttccagttgattgggtcccaaccagccgtaccacctggtcgatccatgcccaccaccaatggatgacgacagaagacatgttatcagtgtggaatagggtttggatagaggaaaacccatggatggaggacaaaactcacgtgtccagttgggaagacgttccatacctaggaaaaagggaagatcaatggtgtggatccctaataggcttgacagcgcgagccacctgggccactaacatacaagtggccataaaccaagtgagaaggctcattgggaatgagaattatctagattacatgacatcaatgaagagattcaaaaacgagagtgatcccgaaggggcactctggtaa

SEQ ID NO: 6258 - RNA, 9879 nt, synthetic construct
  misc_feature 1..9879: note = derived and/or modified CDS sequence (wt) from DENV-1__KC762645__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgctggtgcaatgccacagatacatgggtgacctatggaacatgttcccaaactggcgagcaccgacgagacaaacgttccgtcgcactggccccacacgtgggacttggtttggaaacaagaaccgaaacgtggatgtcctccgaaggcgcttggagacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcactgtccacactggagaccagcatcaggtgggaaatgaaagcacagaacatgggacaactgcaactataacacctcaagctcctacgacagaaatacagttgaccgattacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaggatgaaaaaggagtaacccagaatgggagattgataacagccaaccccatagtcactgataaagaaaaaccagtcaacattgaggcagaaccgccttttggtgagagttacatcgtgataggagcaggtgaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttaatttgtgtgagggtaccacggtcgttgtggatgaacattgtggaaatcgaggaccatctcttaggaccacaacagtcacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggcctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgatccaattgagcaggaaaacttttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagagaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaataggaaaacttccacagcacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtacagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcatcggccagaggatagagaacataaaacatgaacacaagtcaacatggcattatgatgaggacaatccatataaaacatgggcctatcatggatcatatgaggtcaagccatcaggatcagcctcatctatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6259 - RNA, 9879 nt, synthetic construct
  misc_feature 1..9879: note = derived and/or modified CDS sequence (wt) from DENV-1__KC762628__SS-prME
  source 1..9879: mol_type = other RNA
tctgtgaccatgctcctcatgctgctgcccacagccctggcgttccatctgaccacccgaggaggagagccgcacatgatagtcagcaagcaagaaagaggaaaatcacttttgttcaagacctctgcaggtgtcaacatgtgtacccttattgcaatggatttgggagagttatgtgaagacacaatgacctacaaatgcccccggatcactgagacggaaccagatgacgttgactgttggtgcaatgccacggagacatgggtgacctatggaacatgttcacaaactggtgaacaccgacgagacaaacgttccgtcgcattggcaccacacgtagggcttggtctagaaacaagaaccgaaacgtggatgtcctctgaaggcgcttggagacaaatacaaaaagtggagacttgggctctaagacacccaggattcacggtgatagccctttttctagcacatgctataggaacatccatcacccagaaagggattatttttattttgctgatgctggtaactccatccatggccatgcggtgcgtgggaataggcaacagagacttcgtggaaggactctcaggagctacgtgggtggatgtggtgctggagcatggaagttgcgtcactaccatggcaaaagacaaaccaacactggacattgaactcctgaagacggaggtcacaaaccctgcagtcctgcgcaaattgtgcattgaagctaaaatatcaaacaccaccaccgattcgagatgtccaacacaaggagaagccacgctggtggaagagcaggacacgaattttgtgtgccgacgaacgttcgtggacagaggctggggcaatggttgtgggctattcggaaaaggtagcttaataacgtgtgccaagtttaagtgtgtgacaaaactagaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacattggattgttcacctagaacagggttagactttaatgagatggtgttgttgacaatgaaagaaaaatcatggctcgtccacaaacaatggtttctagacttaccactgccttggacctcgggggcttcaacatcccaagagacttggaacagacaagacttgctggtcacatttaagacagctcatgcaaaaaagcaggaagtagtcgtactaggatcacaagaaggagcaatgcacactgcgctaactggagcgacagaaatccaaacgtctggaacgacaacaattttcgcaggacacctgaaatgcagactaaaaatggataaactgaccttaaaaggggtgtcatatgtaatgtgcacagggtcattcaagctagagaaggaagtggctgagactcagcatggaactgttctagtgcaggtcaaatacgaaggaacagatgcaccatgcaagatccccttctcgtcccaagatgagaagggagtgacccagaatgggagattgataacagccaaccccatagtcactgacaaagaaaaaccagttaacattgaagcggagccaccttttggtgagagctaccttgtggtaggagcaggtgaaaaagctttgaaactaagctggttcaagaagggaagcagcataggaaagatgtttgaagcaaccgctcgtggagcgcgaaggatggccatcttgggagacaccgcatgggacttcggttctataggaggggtgtttacgtctgtgggaaaattgatacaccagatttttgggactgcgtatggagttttgttcagcggggtttcttggactatgaaaataggaatagggattctgctgacatggctaggattaaattcaaggagcacgtccctttcaatgacgtgtatcgcagttggcatggtcacactgtacctaggagtcatggttcaggcggactcgggatgtgtaatcaactggaaaggcagagaactcaaatgtggaagcggcatctttgtcaccaatgaagtccacacctggacagagcaatacaaattccaagctgactcccccaagagactatcagcggccattgggaaggcatgggaggagggtgtgtgtggaatccgatcagccactcgcctcgaaaacattatgtggaagcaaatatcaaatgaactaaaccacatcttacttgaaaatgacatgaaatttacagtggtcgtaggagaagttaatggaatcttggcccaaggaaagaaaatgattaggccacaacccatggaacacaaatattcgtggaaaagctggggaaaagccaaagtcataggagcagatgtacagaataccaccttcatcatcgacggcccaaacaccccagaatgccctgataatcaaagagcatggaacatctgggaagtcgaagactatggatttggaattttcacgacaaacatatggttgaaactgcgtgactcctacactcaagtgtgtgaccaccggctaatgtcagctgccatcaaggatagcaaagcagtccatgctgacatggggtactggatagaaagtgaaaagaacgagacttggaagttggcaagagcctccttcatagaagttaagacatgcatctggccaaaatcccataccctatggagcaatggagtcctggaaagtgaaatgataatcccaaaaatatatggaggaccaatatctcagcacaactacagaccaggatatttcacacaaacagcagggccgtggcacttgggcaagttagaactggattttgagttgtgtgaaggtaccaccgttgttgtggatgaacattgtggaagtcgaggaccatctcttagaaccacaacagtcacaggaaagataatccatgaatggtgctgcagatcttgcacgttaccccccctacgtttcaaaggagaagacgggtgctggtacggtatggaaatcagaccagtcaaggagaaggaagagaacctagttaaatcaatggtctctgcagggtcaggagaagtggacagtttttcactaggactgctatgcatgtcaataatgatcgaagaagtgatgagatccagatggagtagaaaaatgctgatgactggaacattggctgtgttcctcctccttacaatgggacaattgacatggaatgatctgatcaggctatgtatcatggttggagccaatgcttcagacaagatggggatgggaacaacgcacctagctttgatggccactttcagaatgagaccaatgttcgcagtcgggctactgtttcgcagattaacgtctagagaagttcttcttcttacagttggattgagtctagtggcatctgtagaactaccaaattccttggaggagctaggggatggacttgcaatgggcatcatgatgttgaaattactaactgattttcagtcacaccagctatgggctgccttgctgtctctaacatttgttaaaacaactttatcactgcattacgcatggaagacaatggctatgatactgtcaattgtatctctcttccctctatgcctgtccacgacttctcaaaaaacaacatggctcccggtgttgctgggatctcttggatgcaaaccattaaccatgtttcttataacagaaaacaaaatctggggaaggaaaagctggcctctcaatgagggaattatggctgttggaatagttagtattcttctaagctcactcctcaaaaatgatgtgccactagctggcccactaatagctggaggcatgctaatagcatgttatgtcatatctggaagctcggccgatttatcattggagaaagcggctgaggtctcctgggaagaagaagcagaacactctggtgcctcacacaacatactagtggaggtccaagatgatggaaccatgaagataaaggatgaagagagagatgacacacttaccattctcctcaaagcaactttgctagcaatctcaggggtgtacccaatgtcaataccggcgaccctctttgtgtggtacttttggcagaaaaagaaacagagatcaggagtgctatgggacacacccagccctccagaagtggaaagagcagtccttgatgatggcatttatagaattctccaaagaggactgttgggcaagtctcaagtaggagtaggagtttttcaagaaggtgtgtttcacacaatgtggcacgtcactaggggagctgttctcatgtatcaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaacgtgcagacagcgccgggtacctttaagactcctgaaggcgaagttggagctatagctctagactttaaacccggcacatctggatctcctattgtgaacagggagggaaaaatagtaggtctttatggaaatggagtggtgacaacaagtggaacctacgtcagtgccatagctcaagccaaagcatcacaagaaggacctctaccagagattgaggacgaggtgtttaggaaaagaaacttaacaataatggacttacacccaggatcgggaaaaacaagaagataccttccagccatagtccgtgaggctataaaaagaaagttacgcacgctagtcttagctcccacaagagttgtcgcctctgaaatggcagaggcgctcaagggaatgccaataaggtaccagacaacagcagtgaaaagtgaacacacgggaaaggagatagttgaccttatgtgtcacgccacttttaccatgcgtctcctttcccctgtgagagttcccaattataatatgattatcatggatgaagcacatttcactgatccagccagcatagcagccagagggtatatctcaacccgagtgggtatgggtgaagcagctgcaattttcatgacagccactccccccggatcgatagaggcctttccacagagcaatgcagctatccaagatgaggaaagagacattcctgaaaggtcatggaactcaggctatgactggattaccgattttccaggtaaaacagtttggtttgttccaagcatcaaatcaggaaatgatattgccaactgtttaagaaagaatgggaaacgggtgatccaattgagcagaaaaaccttcgacactgagtaccagaagacaaaaaataacgactgggactatgttgtcacaacagacatatccgaaatgggagcaaacttccgagcagacagggtaatagacccgaggcggtgcctgaaaccagtaatactaaaagatggcccagagcgtgtcattctagccggaccgatgccagtgactgtggctagcgccgcccagaggagaggaagaattggaaggaaccaaaataaggaaggcgatcagtatatttacatgggacagcctctaaacaatgatgaggaccacgcccattggacagaagcaaaaatgctccttgacaacataaacacaccagaagggattatcccagccctctttgagccggagagagaaaagagtgcagcaatagacggggaatacagactacggggtgaagcgaggaaaactttcgtggagcttatgagaagaggagatctacctgtctggctatcctacaaagttgcctcagaaggcttccagtactccgacagaaggtggtgctttgatggagaaaggaacaaccaggtgctggaggagaacatggacgtggagatctggacaaaagaaggagaaagaaagaaactacggccccgctggctggatgccagaacatactctgacccactggctctgcgcgaattcaaagagttcgcagcaggaagaagaagcgtctcaggtgacctaatattagaaatagggaaacttccacaacatttaacgcaaagggcccagaatgccttggacaacctggttatgctgcacaactctgaacagggaggaaaagcctatagacacgccatggaagaactaccagacaccatagaaacgttaatgcttctggctttgatagctgtgctgactggtggggtgacgctgttcttcctatcaggaaggggtctaggaaaaacatccattggcctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatactgacagtggcagccaatgagatgggattactggaaaccacaaagaaggacctagggattggtcatgcagctgctgaaaaccaccatcatgctgcaatgctggacgtagacctacatccagcttcagcctggaccctctatgcagtggccacaacaattattactcccatgatgagacacacaatcgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgttagtggctcattacgccataattggacccggattgcaagcaaaagctactagagaagctcaaaaaaggacagcagctggaataatgaaaaacccaactgttgatgggatcgttgcaatagatttggaccctgtagtttacgatgcaaaatttgaaaaacagctaggccaaataatgctgttaatactctgcacatcacagatcctcctgatgcggaccacatgggccttgtgtgaatccatcacactagccactggacctctgaccacactctgggagggatctccaggaaaattctggaacaccacgatagcggtgtccatggcaaacatttttaggggaagttatctagcaggagcaggtctggccttttcattaatgaaatctctagggggaggtaggagaggtacgggagctcaaggggaaacgctgggagaaaaatggaaaagacagctaaaccaattgagcaagtcagaattcaacacttacaaaaggagtgggatcatggaggtggacagatctgaagccaaagaggggttgaaaagaggagaaacgactaaacacgcggtgtcgagaggaacggccaaactgaggtggtttgtagagagaaaccttgtgaaaccagagggaaaagtcatagacctcggttgtggaagaggtggctggtcatactattgcgctgggctgaagaaagtcacagaagtgaaaggatacacgaaaggaggacctgggcatgaagaaccaattccaatggcaacctatggatggaacctagtaaagctacactccgggaaagatgtattctttacaccacctgagaaatgtgacactctcttgtgtgatattggtgagtcctctccgaacccaaccatagaagaaggaagaacattacgtgttctaaggatggtggaaccatggctcagaggaaaccaattttgcataaaagttctaaatccctatatgccgagtgtgatagaaactttggagcagatgcagagaaaacatggaggaatgctagtgcgaaatccactctcaagaaactccactcatgaaatgtactgggtttcatgtggaacaggcaatattgtgtcagcagtaaacatgacatctagaatgctgctaaatcgattcacaatggctcacaggaagccaacatatgaaagagacgtggacttaggcgctggaacaagacatgtggcagtagaaccagaggtggccaacctagatatcattggccagaggatagagaatataaaaaatgaacacaaatcaacatggcattatgatgaggataatccatacaaaacatgggcctatcatggatcatatgaggtcaagccatcaggatcagcctcatccatggtcaatggtgtggtgagactgctaaccaaaccatgggatgtcatccccatggtcacacaaatagccatgactgacaccacaccctttggacaacagagggtgttcaaagagaaagttgacacgcgcacaccaaaagcgaaacgaggcacagcacaaattatggaggtgacagctaggtggttatggggttttctctctagaaacaaaaaacccagaatctgcacaagagaggaattcacaagaaaagtcaggtcaaacgcagctatcggagcagtgttcgttgatgaaaatcaatggaactcagcaaaagaggcagtggaagatgaacggttctgggaccttgtgcacagagagagggagcttcataaacaaggaaaatgtgccacgtgtgtctacaacatgatgggaaagagagagaaaaaactaggagagttcggaaaggcaaaaggaagccgcgcaatatggtacatgtggttgggagcgcgctttttagagtttgaagcccttggtttcatgaatgaagatcactggttcagcagagagaattcactcagtggagtggagggagaaggactccacaaacttggatacatactcagagacatatcaaagattccagggggaaatatgtatgcagatgacacagccggatgggacacaagaataacagaggatgatcttcagaatgaggccaaaatcactgacatcatggaacctgaacatgctctattggccacgtcaatctttaagctaacctaccaaaacaaggtagtaagggtgcagagaccagcgaaaaatggaaccgtgatggatgtcatatccagacgtgaccagagaggaagtggacaggttggaacctatggcttaaacaccttcaccaacatggaggcccaactaataagacaaatggagtctgagggaatctttacacccagcgaattggaaaccccaaatctagccgaaagagttctcgactggttggaaaaacatggcatcgagaggctgaaaagaatggcaatcagtggagatgactgtgtggtgaaaccaatcgatgacagattcgcaacagcattaacagctttgaatgacatgggaaaggtaagaaaagacataccgcaatgggaaccatcaaaaggatggaatgattggcaacaagtgcctttctgttcacaccatttccaccaactgattatgaaggatgggagggagatagtggtgccatgccgcaaccaagatgaacttgtgggtagggccagagtatcacaaggcgctggatggagcctgagagaaactgcatgcctaggcaagtcatatgcacaaatgtggcagctgatgtacttccacaggagagacttgagattagcagctaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcacgtgtccagttgggaagacgttccatacctaggaaaaagggaagatcaatggtgtggatccctaataggcttgacagcgcgagccacctgggccactaacatacaagtggccataaaccaagtgagaaggctcattgggaatgagaattatctagattacatgacatcaatgaagagattcaaaaacgagagtgatcccgaaggggcactctggtaa

SEQ ID NO: 6260 - RNA, 9879 nt, synthetic construct
  misc_feature 1..9879: note = derived and/or modified CDS sequence (wt) from DENV-1__KC762624__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggaaacttgggccctgagacacccaggattcacggtgatagccctttttctagcacatgccataggaacatccatcacccagaaagggattatcttcattttgttaatgctggtcacaccatccatggccatgcgatgcgtgggaataggtagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctctcacattggattgttcacctaggacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtagctgagacccagcatggaaccgttctagtgcagatcaaatacgaaggaacagatgcaccatgcaagattcctttttcgacccaagatgaaaaaggagtaacccagaatgggagattgataacagccaaccccatagtcaccgataaagaaaaaccagtcaacattgaggcagaaccgccttttggtgagagttacatcgtgataggagcaggtgaaaaagctttaaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggtctagtaacgctatacttaggagtcatggttcaggcggattcaggatgtgtaattaattggaaaggtagagaactcaaatgtggaagtggcatttttgtcaccaatgaagttcacacctggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaaaataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcttccgacaggatggggatgggaacgacgtacctagctctgatggccacttttaaaatgagaccaatgtttgctgtagggctactattccgcagactaacatccagagaagttcttcttctgacaattggattaagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacccagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagttgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctctaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaactttgatgctcctagctttgatagctgtgttaactggtggagtgacgctgttcttcctgtcaggaaggggcttaggaaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgataaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccagataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagcgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtgaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggttaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatgtatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6261 - RNA, 9879 nt, synthetic construct
  misc_feature 1..9879: note = derived and/or modified CDS sequence (wt) from DENV-1__KC762644__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagcccttttcctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaagggaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaatcccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaataccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagttacaggaaagataattcatgaatggtgttgtagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtatttttggcagaaaaagaaacagagatccggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaacccaaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattataatatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtttggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagtgtctcaggagatttaatattagaaatagggaaacttccacaacacttgacgcaaagggcccagaatgccttggacaacctggttatgttacacaactccgaacaaggaggaagagcctatagacatgcaatggaagaattgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagccactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacactctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatctttgagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaagggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagcgatcccgaaggggcactctggtga

SEQ ID NO: 6262 - RNA, 9879 nt, synthetic construct
  misc_feature 1..9879: note = derived and/or modified CDS sequence (wt) from DENV-1__KC762630__SS-prME
  source 1..9879: mol_type = other RNA
tctgtgaccgtgctgttcatgctgctgcccacagccctggcgttccatctgaccacccgagggggagaaccgcacatgatagttagcaagcaggaaagaggaaagtcacttttgttcaagacctctgcaggtgtcaacatgtgtacccttattgcaatggacttgggagagttgtgtgaggacacaatgacctacaaatgcccccggatcactgaaacggaaccagatgacgttgactgttggtgcaacgccacggagacatgggtgacttatggaacatgttctcaaactggtgaacaccgacgagacaaacgttctgttgcactggcaccacacgtagggcttggtctagaaacaagaaccgaaacgtggatgtcctctgaaggcgcttggaaacaaatacaaaaagtggagacctgggctctgagacacccaggattcacggtgatagctcttttcctagcacatgccataggaacatccattacccagaaaggaattattttcattttactgatgctggtaactccatccatggccatgcggtgcgtaggaataggcaacagagacttcgtggaaggactgtcaggagctacgtgggtggatgtggtactggagcatggaagttgtgtcactacaatggcaaaaaacaaaccaacactggatattgaactcttaaagacggaggttacaaacccagccatcctgcgcaaactgtgcattgaagccaaaatatcaaatactaccaccgattcgagatgtccaacacaaggagaagccacgctggtggaagaacaagacacgaacttcgtgtgtcgacgaacgttcgtggacagaggctggggcaatggttgtgggctatttggaaaaggtagcttaataacgtgtgctaagtttaagtgtgtgacaaaattggaaggaaagatagtccaatatgaaaatttaaaatattcagtgatagtcaccgtccacactggagaccagcaccaagttgggaatgagactacagaacatggaacaactgcaatcataacacctcaagctcctacgtcggaaatacagctgacagactacggagctttaacactggactgttcacctagaacagggctagacttcaatgagatggtgttgttgacaatgaaagaaaaatcatggctcgtccacaaacaatggtttctagacttaccgctgccttggacctcgggggcttcaacatcccaagagacttggaatagacaagacttgctggtcacattcaagacagctcatgcaaagaagcaggaagtagttgtactaggatcacaagaaggagcgatgcacactgcgctgactggagcaacagaaatccaaacgtctggaacgacaacaattttcgcaggacacctgaaatgcagactgaaaatggataaactaactttaaaaggggtatcatacgtaatgtgcacaggctcattcaagctagaaaaggaagtggctgagacccagcatggaactgttctagtgcaggttaagtacgaaggaacagatgcaccatgtaagatccccttctcatcccaagatgagaagggagtaatccagaatgggagattgataacagccaaccccatagtcactgacaaagaaaaaccagtcaacattgaggcggagccaccttttggtgagagctacatcgtggtaggagcaggtgagaaagctttgaaactaagctggttcaagaagggaagcagtatagggaaaatgtttgaagcaactgcccgtggagcacgaaggatggccattctgggagacactgcatgggactttggttctataggaggagtgttcacgtccgtgggaaaactggtacaccagatttttggaactgcgtacggagttttgttcagcggtgtttcttggaccatgaaaataggaatagggattctgctgacatggctaggattaaattcaaggagcacgtccctttcaatgacgtgtatcgcagttggcatggtcacactgtacctaggagtcatggttcaggcggactcgggatgtgtaattaactggaaaggcagagaactcaaatgcggaagcggcatttttgtcactaatgaagttcacacctggacagagcaatacaaattccaggccgactccccaaagagactatcagcagccattgggaaggcatgggaggagggtgtgtgtggaattcggtcagccactcgtctcgaaaacatcatgtggaagcaaatatcaaatgaattaaaccacatcttacttgaaaatgacatgaaattcacagtggtcgtaggagatgtcagtgggatcttggcccaaggaaagaaaatgattaggccacaacccatggaacacaaatactcgtggaaaagctggggaaaagccaagatcataggagcagatgtacagaacaccaccttcatcatcgacggcccaaacaccccagaatgccctgataaccaaagagcatggaacatctgggaagttgaagactatggatttggaattttcacgacaaacatatggttaaaattgcgtgactcttatacccaagtatgtgaccaccggctaatgtcagctgccattaaggatagcaaagcagtccatgctgacatggggtactggatagaaagtgaaaagaacgagacttggaagttggcaagagcctccttcatagaagtcaagacatgcatctggccaaaatcccacactctatggagcaatggagtccttgaaagtgagatgataatcccaaagatatatggaggaccagtatctcagcacaactacagaccaggatatttcacacaaacagcagggccatggcacttaggcaagttggaactagattttgatttgtgtgaaggtaccacagttgttgtggatgaaaattgtggaaatcgaggaccatctcttagaaccacaacagtcacaggaaagacaatccatgaatggtgctgtagatcttgcacgttaccccctctacgtttcaaaggggaagacgggtgctggtacggtatggaaatcagaccagtcaaggagaaggaagagaacctagttaagtcaatggtctctgcagggtcaggagaagtggatagcttttcactaggactgctatgcatatcaataatgatcgaagaggtaatgagatccagatggagcagaaagatgctgatgactggaacattggctgtgttcctccttctcacaatgggacaattgacatggaatgatctgatcaggctatgtatcatggtcggagccaatgcttcagacatgatggggatgggaacaacgtacctagctttgatggccactttcagaatgagaccaatgttcgcagtcggactcttatttcgcagattaacatctagagaaattcttcttcttacagttggattgagcctggtggcatctgtagaactaccaaattccttagaagagctaggggatggacttgcaatgggcatcatgatgttgaaattattgactgattttcagccacatcagctatgggctaccttgctgtctttaacatttgtcaaaacaactctttcattgcactatgcatggaagacaatggccatgatactatcaattgtgtctctcctccctttgtgcctgtccacgacatctcaaaaaacgacatggcttccggtgctgctgggatctcttggatgcaaaccactaaccatgtttcttataacagaaaacaaaatttgggggaggagaagttggcccctcaatgaaggaattatggctattggaatagtaagcatcctactaagttcacttctcaaaaatgatgtaccactagctggcccactaatagctggaggcatgctaatagcatgttatgtcatatctggaagctcggccgacctatcactggagaaagcggctgaggtttcctgggaagatgaagcagaacactctggtgcctcacacaacatactagtggaggtccaagatgacggaaccatgaagataaaagatgaagagagagatgacacactcaccattctcctcaaagcaactctgttagtaatctcaggggtatacccaatgtcagtaccggcgaccctctttgtgtggtatttttggcagaaaaagaaacagagatcaggagtgctatgggacacacccagccctccagaagtggaaagagcagtccttgacaatggcatttatagaattctccaaagaggattgttgggcaggtctcaagtaggagtaggagtttttcaagaaggtgtgttccacacaatgtggcacgtcaccaggggagctgttctcatgtaccaagggaagagattggaaccaagttgggctagtgtcaaaaaagacttgatctcatatggaggaggttggaggtttcaaggatcctggaacacgggagaagaagtgcaggtgattgctgttgaaccggggaagaaccccaaaaatgtacagacaacgccaggcaccttcaagacccctgaaggtgaaattggagctatcgctctagacttcaaacccggcacatctggatctcctatcgtgaacagagagggaaaaatagtgggtctttatggaaatggagtggtgacaacaagtggaacctacgtcagtgccatagctcaagctaaagtatcacaagaagggcccctaccagagattgaggacgaggtgtttaggaaaaggaatttaacaataatggacctacatccaggatcagggaaaacaagaagataccttccagccatagtccgtgaggccataaaaagaaagttgcgcacgctagtcttggcccccacaagagttgtcgcttctgaaatggcagaagcgcttaagggaatgccaataaggtatcagacaacagcagtgaaaagtgaacacacgggaaaggagatagttgatctcatgtgccacgccactttcactatgcgtctcctgtctcctgtgagagtccccaattataacatgattatcatggatgaagcacatttcaccgatccagccagtatagcagccagagggtacatctcaacccgagtaggtatgggcgaagcagctgcgatcttcatgacagccactccccccggatcggtggaggcctttccacagagcaatgcagttatccaagatgaggaaagagacattcctgaaagatcatggaactcaggctatgaatggatcactgatttcccaggaaaaacagtctggtttgttccaagcatcaaatcaggaaatgacattgccaactgtttaagaaagaatgggaaacgggtggtccaattgagcaggaaaacttttgacactgagtaccagaaaacaaaaaacaacgactgggactatgttgtcacaacagacatatccgaaatgggagcaaacttccgagccgacagggtaatagacccaaggcggtgcctgaaaccagtaatactaaaagatggtccagagcgtgtcatcctagccggaccgatgccagtgactgtggctagtgccgcccagaggagaggaagaattggaaggaacccaaataaggaaggtgatcagtacgtgtacatgggacagcctctaaacaatgatgaggaccacgcccattggacagaagcaaaaatgctccttgacaacataaacacaccagaagggatcatcccagccctctttgagccggagagagaaaagagtgcagcaatagacggggaatacagattacggggtgaagcaaggaaaacgttcgtggagctcatgagaagaggagatctacctgtctggctatcctacaaagttgcctcagaaggcttccagtactccgacagaaggtggtgctttgatggggaaaggaacaaccaggtgttggaggagaacatggacgtggaaatttggacaaaagaaggagaaagaaagaaactacgaccccgctggctggatgccagaacatattctgacccactggctctgcgcgaattcaaagagttcgcagcaggaagaagaagtgtctcaggtgacctaatattagaaatagggaaacttccacaacatttaacgctaaaagctcagaatgctttggataatctggtcatgctgcacaactctgaacagggaggaaaggcctacagacacgccatggaagaactaccagataccatagaaacgttaatgctcctagctctgatagctgtgctgactggtggagtgacgctgttcttcctatcaggaagaggtctaggaaaaacatccattggcctactctgtgtgatggcctcaagtgcactgttgtggatggccagtgtggagcctcattggatagcggcctctatcatactggagttctttctgatggtgttgcttattccagagccagaccgacagcgcactccacaagacaaccagctagcatatgtggtgataggtttgttattcatgatattgacagtggctgccaatgagatgggattgttggaaaccacaaagaaagacctggggattggtcatgcagctgctgaaaaccaccaccatgctgcaatgctggacgtggacctacatccagcttcagcctggactctctatgcagtggccacaacaattatcactcccatgatgagacacacaattgaaaacacaacggcaaatatttccctgacagctatcgcaaaccaggcagctatattgatgggacttgacaagggatggccaatatcaaagatggacataggagttccacttctcgccttggggtgctattctcaggtgaacccgctgacgctgacagcggcggtattgatgctagtggctcactatgccataattggacctggactgcaggcaaaagctactagagaagctcaaaaaaggacagcagctggaataatgaaaaacccaactgtcgacggtatcgttgcaatagatttggaccctgtaatttacgatgcaaaatttgaaaaacagctgggccaaataatgttgttgatactttgcacatcacagattctcctaatgcggaccacatgggccttgtgtgaatccatcacattggccactggacctctgaccacgctttgggagggatctccaggaaaattctggaatacaactatagcggtgtccatggcaaacatcttcaggggaagttatctagcgggagcaggtctggccttttcattgatgaaatctctaggaggaggtaggagaggcacaggagcccaaggagaaacgctgggagaaaaatggaaaagacagctaaaccaattgagcaaatcagaatttaacatttacaagaggagtgggattatagaggtggatagatctgaagccaaagaggggttgaaaagaggagaaacaaccaaacatgcagtgtcgagaggaacggccaaattgaggtggtttgtggagaggaaccttgtgaaaccagaagggaaagtcattgacctcggttgtggaagaggtggctggtcatattactgcgctgggctgaagaaagtcacagaagtaaaaggatacacgaaaggaggacctggacatgaggaaccaatcccaatggcaacctatggatggaacctagtaaagctacactccggaaaagatgtattctttacaccacctgagaaatgtgacacccttttgtgtgatatcggtgagtcctctccgaacccaactatagaagaaggaagaacattacgtgttctaaagatggtggaaccatggctcagaggaaatcaattttgcataaaaattctaaatccctacatgccgagtgtggtagaaaccctggagcaaatgcaaaggaagcatggaggaatgctagtgcgaaatccactctcaagaaactccactcatgaaatgtactgggtttcatgtggaacaggaaacattgtgtcagcagtgaacatgacatctagaatgctgctaaatcgattcacaatggctcacaggaaaccaacatatgaaagagacgtggacttaggcgctggaacaagacatgtggcagtggaaccagaggtggccaacttagatatcattggccagaggatagagaatataaaaaatgaacacaaatcaacatggcattatgatgaggacaatccatacaaaacatgggcctatcatggatcatatgaggtcaagccatcaggatcagcttcatccatggtcaatggtgtggtgagactgctaaccaaaccatgggatgtcattcccatggtcacacaaatagccatgactgacaccacaccctttggacaacagagggtgtttaaagagaaagttgatacgcgcacaccaaaagcgaaacgaggcacagcgcaaattatggaggtaacagccaggtggttatggggttttctctctagaaacaaaaaacccagaatctgcacaagggaggagttcacaagaaaagttaggtcaaacgcagccattggagcagtgttcgttgatgaaaatcagtggaactcagcaaaagaggcagtggaagatgaacggttttgggaccttgtgcacagagagagagagcttcataaacaaggaaaatgtgccacgtgcgtctacaacatgatgggaaagagagagaaaaaattaggagagttcggaaaggcaaaaggaagtcgcgcaatatggtacatgtggttgggagcgcgctttttagagtttgaagccctaggtttcatgaatgaggatcattggttcagcagagagaattcacttagtggagtggaaggagaaggactccacaaacttggatacatacttagagacatatcaaagattccagggggaaatatgtatgcagatgacacagccggatgggacacaagaataacagaggatgatcttcagaatgaggcaaaaatcactgacatcatggaacctgaacatgccctattggccacgtcaatctttaagctaacctaccaaaacaaggtagtaagggtgcagagaccaggaaaaaatggaaccgtgatggatgtcatatccagacgtgaccagagaggaagtggacaggttggaacctatggcttaaacaccttcactaacatggaggcccaactaataagacaaatggagtctgagggaatcttttcacctagcgaattggaaaccccaaacctagctgaaagagtcttcgactggttggaaaaacatggcatcgagaggctgaaaagaatggcaattagtggagatgactgtgtggtgaaaccaattgatgacagatttgcaacagccttaacagccttgaatgacatgggaaaggtaagaaaagacataccgcaatgggaaccctcaaaaggatggaacgattggcaacaagtgcctttttgttcacaccatttccaccagctgattatgaaggatgggagggagatagtggtgccatgccgcaaccaagatgaacttgtgggtagggccagagtctcacaaggcgccggatggagcttaagagaaactgcatgcctaggcaagtcatatgcacaaatgtggcagctgatgtacttccacaggagagatttgagactagcggctaatgccatctgttcagccgttccagttgactgggtcccaaccagccgcaccacctggtcgatccatgcccaccatcagtggatgacaacagaagacatgttgtcagtatggaatagggtttggatagaggaaaatccatggatggaggacaaaactcatgtgtccagttgggaagacgttccatacctaggaaaaagggaagatcaatggtgtggatccctaataggcttaacagcacgagccacctgggccaccaacatacaagtggccataaaccaagtgagaaggctcattgggaacgagaactatctagactatatgacatcaatgaagagattcaaaaacgagagtgatcctgaaggggcactctggtaa

SEQ ID NO: 6263 - RNA, 9879 nt, synthetic construct
  misc_feature 1..9879: note = derived and/or modified CDS sequence (wt) from DENV-1__KC762641__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacttcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaataccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataatcccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttcgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaattgctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatccggagtgttatgggacacacctagccctccagaagtagaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaattgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtaacagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgcggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccaggaggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggttagggtacagagaccagcaaaaaatggaaccgtgatggatgtcatatccagacgagaccagagaggaagtggccaggtcggaacttatggcttgaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6264 - RNA, 9879 nt, synthetic construct
  misc_feature 1..9879: note = derived and/or modified CDS sequence (wt) from DENV-1__KC762648__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggcgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcatcgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacatgtgctaagttcaagtgtgtgacaaaactggaaggaaaaatagttcagtatgaaaacttgaaatattcagtaatagtcaccgtccacactggagatcagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacatcgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctctcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgtcgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgcttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtgctgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaggagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagttgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttaggaaaaacatctatcggcctactctgcgtgatggcttcaagcgcactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggatcggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcaaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaagttttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggttgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcggaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacaccttcaccaacatggaagcccagctaataagacaaatggagtctgaggaaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcttgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6265 - RNA, 9879 nt, synthetic construct
  misc_feature 1..9879: note = derived and/or modified CDS sequence (wt) from DENV-1__KC762622__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatggccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcataggaaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggtctagtaacactatacttaggagtcatggttcaggcggattcaggatgtgtaattaattggaaaggtagagaactcaaatgtggaagtggcatttttgtcaccaatgaagttcacacctggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaacatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaaaataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaatgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatccctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggagtgtacccattatcaataccagcgaccctttttgtgtggtacttttggcagaaaaagaaacagagatctggagtgttatgggacacacccagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaggggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagttgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgttgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaactttgatgctcttagctttgatagctgtgctaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgataaaggatggccaatatcgaagatggacataggagttccacttctcgccttggggtgctattcccaagtgaatccactgacgctgacagcggcggtgttgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccagataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacaggagcccaaggggaaacactgggagagaaatggaaaagacagctgaaccaactgagcaagtcagaattcaacacctataaaaggagcgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggttaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttgtggggttttctttctagaaacaagaagccaagaatttgtacaagagaggagtttataagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaggcccatgtatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6266 - RNA, 9879 nt, synthetic construct
  misc_feature 1..9879: note = derived and/or modified CDS sequence (wt) from DENV-1__KC762629__SS-prME
  source 1..9879: mol_type = other RNA
tctgtgaccatgctccttatgctgatgcctacagccttggcgttccatttgactacacgagggggagagccgcacatggtagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgctggtgcaatgccacagacacatgggtgacctatggaacatgctcccaaactggcgagcaccgacgagacaaacgttccgtcgcactggccccacacgtgggacttggtttggaaacaagaaccgaaacgtggatgtcctccgaaggcgcttggagacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcccacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccaaaatgggagattgataacagccaaccccatagtcactgataaagaaaaaccagtcaacattgaggcagaaccgccttttggtgagagttacatcgtgataggagcaggtgaaaaaactctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgaaaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctgggcaagttggaactggattttaatttgtgtgagggtaccacggtcgttgtggatgaacattgtggaaatcgaggaccatctcttaggaccacaacagtaacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagtttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtagagttaccaaattccttggaggagctgggggatggacttgcaatgggcattatgattttaaaactattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagcagatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgtcgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggcctttatggaaatggagtagtgacaacaagtggaacctacgtcagtgctatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacatacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtctggtttgttccaagcattaaatcaggaaatgatattgccaactgcttaagaaagaatgggaaacgggtgatccaattgagcagaaaaacctttgatacagagtaccaaaaaacaaaaaataacgactgggactacgtcgtcacaacagatatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagagaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaataggaaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacactacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcatcggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagggaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6267 - RNA, 9879 nt, synthetic construct
  misc_feature 1..9879: note = derived and/or modified CDS sequence (wt) from DENV-1__KC762627__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgtgtcactaccatggcaaaagacaaaccaacattggacattgaactcttgaagacggaagtcacaaaccctgccgtcctgcgcaaactatgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagacttcaatgaaatggtgttgttgacaatgaaagaaaaatcatggctagtccacaaacaatggtttctagacctaccattgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtccggaacgacaacaatctttgcaggacacttgaaatgtagactaaagatggacaaactgaccctaaaagggatgtcatatgtgatgtgcacaggctcattcaagctagagaaagaagtggctgagacccagcacggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctctgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattaatacaccagatctttggaactgcatatggagttttgttcagcggtgtttcctggaccatgaaaataggaataggggttctgctgacatggctaggattaaactcaaggagcacgtccctttcgatgacgtgcattgcagttggcctagtaacgctatacttaggagtcatggttcaggcggattcaggatgtgtaattaattggaaaggtagagaactcaagtgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaatgatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccctgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaagccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgattttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgcccactggacggaagcaaaaatgctccttgataatataaacacaccagaagggattatcccagccctcttcgagccggagagagaaaaaagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggggaaagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaagggcccagaatgccttggacaacctggttatgttacacaactccgaacaaggaggaagagcctatagacatgcaatggaagaactgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgttggaaaccacaaagaaagacttagggattggtcatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccatcgcaaaccaggcagccatattgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggatcatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcaacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggtacaacacaaatcatggaggtgacagccaggtggttatggagttttctttctagaaacaagaagccaagaatttgcacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagcgaattagagacctcaaacttagccgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6268 - RNA, 9879 nt, synthetic construct
  misc_feature 1..9879: note = derived and/or modified CDS sequence (wt) from DENV-1__KC762647__SS-prME
  source 1..9879: mol_type = other RNA
tctgtgaccatgctccttatgctgacgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttaaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcagggcagttcacgctgacatggggtactggatagaaagtgaaaagaacgagacctggaagctggcaagagcctctttcatagaagtcaaaacatgtgtctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttcgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatccggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaagtgtttaggaaaagaaacttaacaataatggatctacatccaggatcggggaaaacaagaagataccttccagccatagtccgtgaggccataaaaaggaagctgcgcacactaattctggcccccacaagggttgtcgcttccgaaatggcagaggcgctcaaaggaatgccaataaggtatcaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgatagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagagagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaaaggcccagaatgccttggacaacctggttatgttacacaactccgaacaaggaggaagagcctatagacatgcaatggaagaattgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaaaggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaagttctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcgggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccataaacttggatatatactcagagacatatcaaagattccaggaggaaacatgtatgcagatgacacagccggatgggatacaaggataacagaggatgaccttcagaatgaggccaaaattactgacatcatggaacccgaacatgccctactggctaaggcaatcttcaaactaacttaccaaaataaagtggtaagggtacagagaccagcaaaaaatggaaccgtgatggatgtcatatccagacgtgaccagagaggaagtggccaggtcggaacttatggcttaaatactttcaccaacatggaagcccagctgataagacaaatggagtctgagggaatcttttcacccagtgaattagagaccccaaatttagccgagagggttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaattgtggtgccatgccgcaaccaagatgaacttgtgggtagagctagagtatcacaaggtgctggatggagcctgagagaacccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccaccaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6269 - RNA, 9879 nt, synthetic construct
  misc_feature 1..9879: note = derived and/or modified CDS sequence (wt) from DENV-1__KC762639__SS-prME
  source 1..9879: mol_type = other RNA
tctgtgaccatgctccttatgctgacgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggtcacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactatgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcagtatgaaaacttgaaatattcagtaatagtcaccgtccacactggagaccagcatcaggtgggaaatgaaagcacagaacatgggacaactgcaactataacacctcaagctcctacgacagaaatacagttgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttaaaatgtagactaaagatggacaaactgactctaaaagggatgtcatatgtgatgtgcacaggctcattcaagctagagaaagaagtggctgagacccagcatggaaccgttctagtgcagatcaaatacgaaggaacagatgcaccatgcaagattcctttttcgacccaagatgaaaaaggagtaacccagaatgggagattgataacagccaaccccatagtcactgataaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtctctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcagggcagttcacgctgacatggggtactggatagaaagtgaaaagaacgagacctggaagctggcaagagcctctttcatagaagtcaaaacatgtgtctggccaaaatctcacactctatggagcaatggagttctggaaagtgaaatgataattccaaagatctatggaggaccaatatctcagcacaactacagaccaggatatttcacacaaacggcagggccgtggcacctaggcaagttggaactggattttgatttgtgtgagggtaccacggtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgttcgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcattatgcatggaagacaatggctatggtactgtcaattgtatctctcttccccttatgcctgtccacgacctcccaaaaaacaacatggcttccggtgctgttgggatctcttggatgtaaaccactaaccatgtttcttatagcagaaaacaaaatctggggaaggaaaagttggcccctcaatgaaggaatcatggctgttggaattgtcagcatcctactaagctcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatccggagtgttatgggacacacctagccctccagaagtggaaagagcagttcttgatgatggtatctatagaatcatgcagagaggactgttgggcagatcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaagtgtttaggaaaagaaacttaacaataatggatctacatccaggatcggggaaaacaagaagataccttccagccatagtccgtgaggccataaaaaggaagctgcgcacactaattctggcccccacaagggttgtcgcttccgaaatggcagaggcgctcaaaggaatgccaataaggtatcaaacaacagcagtgaagagtgaacacacaggaaaagagatagttgacctcatgtgtcacgccactttcaccatgcgcctcctgtctcccgtgagagttcccaattataacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgatagggtgatagacccaagacggtgtctgaaaccggtaatactaaaagatggtccagagcgtgtcattttagcaggaccgatgccagtgactgtggccagtgccgcccagaggagaggaagagttggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagagagaaagaaactacgaccccgttggctggatgccagaacatactcagacccactggccctgcgcgagtttaaagagtttgcagcaggaagaagaagcgtctcaggagatctaatattagaaatagggaaacttccacaacacttgacgcaaaaggcccagaatgccttggacaacctggttatgttacacaactccgaacaaggaggaagagcctatagacatgcaatggaagaattgccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctagccttggggtgctattcccaagtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggggaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaaaggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaagttctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgctggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcgggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacaacacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccataaacttggatatatactcagagacatatcaaagattccaggaggaaacatgtatgcagatgacacagccggatgggatacaaggataacagaggatgaccttcagaatgaggccaaaattactgacatcatggaacccgaacatgccctactggctaaggcaatcttcaaactaacttaccaaaataaagtggtaagggtacagagaccagcaaaaaatggaaccgtgatggatgtcatatccagacgtgaccagagaggaagtggccaggtcggaacttatggcttaaatactttcaccaacatggaagcccagctgataagacaaatggagtctgagggaatcttttcacccagtgaattagagaccccaaatttagccgagagggttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaattgtggtgccatgccgcaaccaagatgaacttgtgggtagagctagagtatcacaaggtgctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgtaccacctggtcgatccatgcccaccaccaatggatgacaacagaagacatgctgtcagtgtggaatagggtttggatagaggaaaacccatggatggaggacaaaacccatatatccagttgggaggatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6270 - RNA, 9879 nt, synthetic construct
  misc_feature 1..9879: note = derived and/or modified CDS sequence (wt) from DENV-1__KC762642__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgtcctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgttactaccatggcaaaagacaaaccaacattggacattgaactcttgaagacggaagtcacaaaccctgccgtcctgcgcaaactgtgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcatcaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacaacacaagaaacttggaacagacaagatttgctggtgacatttaagacagctcatgcaaagaagcaggaagtagtcgtactaggatcacaagaaggagcaatgcacactgcgctgaccggagcgacagaaatccaaacatctggaacgacaacaatttttgcaggacacttgaaatgtagactaaagatggacaaactgactctaaaagggatgtcatatgtgatgtgcacaggctcattcaagctagagaaggaagtggctgagacccagcatggaaccgttctagtgcagatcaaatacgaaggaacagatgcaccatgcaagatccctttttcgacccaagatgaaaaaggagtgacccagaatgggagattgataacagccaaccccatagtcactgacaaagaaaaaccagtcaacattgaggcagaaccgccttttggtgagagttacatcgtgataggagcaggtgaaaaagctttgaaattaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgttgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggtattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaaaatgattaggccacaacccatggaacacaaatactcgtggaaaagctggggaaaggctaaaattataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacggttgttgtggatgaacattgtggaaatcgaggaccatctcttaggaccacaacagtcacaggaaagataatccatgaatggtgttgcagatcttgtacgctaccacccttacgtttcagaggagaagatgggtgctggtacggtatggaaatcaggccagtcaaggagaaggaagagaatctagtcaaatcaatggtctccgcagggtcaggggaagtggacagcttttcactaggactgctatgcatatcaataatgatcgaagaggtgatgagatccagatggagtagaaaaatgctgataactggaacactggctgtgttcttccttctcataatgggacaagtgacatggaatgatctgaccagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggactgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaattgtcagcatcctactaagttcactcctcaaaaatgatgtgccgctagctggaccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaatcatgcagagaggactgttgggcaggtcccaagtaggggtaggagtttttcaagaaaatgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaagagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgtcccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactaccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggcttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatcttgatgggacttgacaaaggatggccaatatcgaagatggacataggagttccacttctcgccttggggtgctattcccaagtgaatccactgacgctgacagcggcggtattgatgctagtggctcattacgctataatcggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatccctaggaggaggtaggagaggcacgggagcccaaggggaaacactgggagagaaatggaaaagacagctgaaccaattgagcaagtcagaattcaacacctataaaaggagtgggattatggaagtggacagatctgaagccaaagagggactgaaaagaggagaaacaaccaagcatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaaaggatatacaaaaggaggacctggacatgaagaaccaatcccaatggcgacctatggatggaacctagtaaagctgcactctgggaaagacgtgttctttataccacctgagaaatgtgacaccctcttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaatatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgacagacactacaccctttggacaacagagggtgttcaaagagaaagttgacacacgcacaccaaaagcaaaacgaggcacagcacaaatcatggaagtgacagccaggtggttatggggttttctttctagaaacaagaagccaagaatctgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggctaaaattactgacatcatggaacccgaacatgccctactggctaaggcagtcttcaagctaacctaccaaaacaaagtggtaagggtacagagaccagcaaaaaatggaactgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctctactggctggaaaaatatggcgtcgaaaggctaaaaagaatggcaatcagtggagatgactgcgtagtgaaaccaattgatgataggtttgcaacagccctaacagctctgaatgatatgggaaaagtaagaaaagatataccgcaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatacgcacaaatgtggcagctgatgtacttccacaggagagacctgagactagctgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6271 - RNA, 9879 nt, synthetic construct
  misc_feature 1..9879: note = derived and/or modified CDS sequence (wt) from DENV-1__JQ915077__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaagggtagcttaataacgtgtgctaagtttaagtgtgtgacaaaattggaaggaaagatagtccaatatgaaaacttaaaatattctgtgatcgttaccgtccacactggagaccagcaccaagttggaaatgagaccacagaacatggaacaattgcaaccataacacctcaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgtagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctctcagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagacgagctaggggatggacttgcaatgggcatcatgatattgaaattactgactgattttcaatcacatcagctatgggccattttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggagaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaatgctttagataatctggttatgctgcacaactctgaacaagggggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgtactgttatggatggccagtgtggagccccattggatagcggcctctattatactagagttctttctgatggtgttgcttattccagagccagatagacagcgcactccacaagacaaccagttagcatatgtggtgataggtttgctatttatgatattgacagtggcagccaatgagatgggattattggaaaccacaaagaaagacctggggattggtcatgcagctgctgaaaaccaccaccacgccgcaatgctggacgtagacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagctcaaaaaaggacggcagccggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaacctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgtacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacccagcgaattggaaaccccaaatttagccggaagagtccttgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcaatgaagagattcaaaaacgagagtgatcccgaaggggcactctggtaa

SEQ ID NO: 6272 - RNA, 9879 nt, synthetic construct
  misc_feature 1..9879: note = derived and/or modified CDS sequence (wt) from DENV-1__JQ915079__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccatagggacatccatcacccagaaaggaattattttcattttgctgatgctggtgactccatccatggccatgcggtgcgtgggaataggaaacagagacttcgtggaaggactgtcaggagctacgtgggtggatgtagttctggaacatggaagttgcgtcactaccatggcaaaagacaaaccaacactggacattgaactcctgaagacggaggtcacaaaccctgccgtcctgcgcaaactgtgtatagaagctaaaatatcaaatactaccactgactcgagatgtccgacacaaggagaagccacgctggtggaagaacaagacacgaactttgtgtgtcgacgaacattcgttgacagaggctggggcaatggttgtggactattcggaaagggtagcttaataacgtgtgctaagtttaagtgtgtgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaagaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctccataggaggagtgttcacgtctgtgggaaaactggtacaccagatctttggaactgcgtatggagttttgttcagcggtgtttcttggaccatgaaaataggaatagggattctgctgacatggctgggattaaactcaaggagtacgtctctttcaatgacgtgtatcgcagttggcatggtcacactgtacctaggagtcatggtccaggcggactcgggatgtgtaatcaactggaaaggcagagaactcaaatgtggaagtggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgcgattcctacacccaagtgtgtgaccatcgactaatgtcggctgccatcaaggatagcaaagcagttcatgctgacatggggtactggatagaaagtgaaaagaacgagacttggaagttggcaagagcctccttcatagaagtcaagacatgcgtctggccaaaatctcacactctatggagcaatggagtcctggaaagtgagatggtaatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttctccttctcacggttggattgagtctggtggcatctgtagaactaccaaattccttagacgagctaggggatggacttgcaatgggcatcatgatattgaaattactgactgattttcaatcacatcagctatgggctactttgctgtctttaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatttggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccattctcctcaaagcaaccctgctggcaatttcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggttccaaggatcctggaacatgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgccatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaagatggtgctttgatggggaaaggaacaaccaggtgttggaggagaacatggacgtggagatctggacaaaggaaggagaaagaaagaaactgcgaccccgctggctggatgccagaacatactctgacccactggctctgcgcgaattcaaagagttcgcagcaggaagaagaagcgtctcaggtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgactggcggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgctcattccagagccagatagacagcgcactccacaagacaaccagttagcatatgtggtgataggtttgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtagccacaacgattatcactcccatgatgagacacacaattgaaaacacaacggcaaatatttccctgacagctattgcaaaccaggcagccatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcacaatttaacacctacaagaggagtgggattatagaagtagatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaatctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaaggaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggacaatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagttgggaagacgttccatacctagggaagagggaagatcaatggtgtggatccctaataggcttaacagcacgagccacctgggccaccaacatacaggtggccataaaccaagtgagaaggctcattgggaatgagaattatctagactacatgacatcaatgaagagattcaaaaacgagagtgatcctgaaggggcactctggtaa

SEQ ID NO: 6273 - RNA, 9879 nt, synthetic construct
  misc_feature 1..9879: note = derived and/or modified CDS sequence (wt) from DENV-1__JQ915080__SS-prME
  source 1..9879: mol_type = other RNA
tctgtgaccatgctccttatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccatagggacatccatcacccagaaaggaattattttcattttgctgatgctggtgactccatccatggccatgcggtgtgtgggaataggaaacagagacttcgtggaaggactgtcaggagctacgtgggtggatgtagttctggaacatggaagttgcgtcactaccatggcaaaagacaaaccaacactggacattgaactcctgaagacggaggtcacaaaccctgccgtcctgcgcaaactgtgtatagaagctaaaatatcaaatactaccactgactcgagatgtccgacacaaggagaagccacgctggtggaagaacaagacacgaactttgtgtgtcgacgaacattcgttgacagaggctggggcaatggttgtggactattcggaaagggtagcttaataacgtgtgctaagtttaagtgtgtgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaagaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctccataggaggagtgttcacgtctgtgggaaaactggtacaccagatctttggaactgcgtatggagttttgttcagcggtgtttcttggaccatgaaaataggaatagggattctgctgacatggctgggattaaactcaaggagtacgtctctttcaatgacgtgtatcgcagttggcatggtcacactgtacctaggagtcatggtccaggcggactcgggatgtgtaatcaactggaaaggcagagaactcaaatgtggaagtggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgcgattcctacacccaagtgtgtgaccatcgactaatgtcggctgccatcaaggatagcaaagcagttcatgctgacatggggtactggatagaaagtgaaaagaacgagacttggaagttggcaagagcctccttcatagaagtcaagacatgcgtctggccaaaatctcacactctatggagcaatggagtcctggaaagtgagatggtaatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttctccttctcacggttggattgagtctggtggcatctgtagaactaccaaattccttagacgagctaggggatggacttgcaatgggcatcatgatattgaaattactgactgattttcaatcacatcagctatgggctactttgctgtctttaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatttggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtagaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggttccaaggatcctggaacatgggagaagaagtgcaggtgattgctgttgaaccggggaagaacccaaaaaatgtacagacagcgccgggtaccttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgccatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctagctcccacaagagttgtcgcctctgaaatggcagaggcactcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcagtggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccgggccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaagatggtgctttgatggggaaaggaacaaccaggtgttggaagagaacatggacgtggagatctggacaaaggaaggagaaagaaagaaactgcgaccccgctggctggatgccagaacatactctgacccactggctctgcgcgaattcaaagagttcgcagcaggaagaagaagcgtctcaggtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgactggcggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgctgctcattccagagccagatagacagcgcactccacaagacaaccagttagcatatgtggtgataggtttgctattcataatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtagccacaacgattatcactcccatgatgagacacacaattgaaaacacaacggcaaatatttccctgacagctattgcaaaccaggcagccatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcacaatttaacacctacaagaggagtgggattatagaagtagatagatctgaagccaaggaggggttgaaaagaggagaaacaaccaaacacgcagtgtcgagaggaacggccaaactgaggtggtttgtggagaggaaccttgtgaaaccagaagggaaagtcatcgacctcggttgtggaagaggtggctggtcatattattgcgctgggctgaagaaagtcacagaagtgaaaggatacacaaaaggaggacctggacatgaggaaccgatcccaatggcaacctatggatggaatctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaaggaaacatggaggaatgttagtgcgaaatccactctcaagaaactccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggacaatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagttgggaagacgttccatacctagggaagagggaagatcaatggtgtggatccctaataggcttaacagcacgagccacctgggccaccaacatacaggtggccataaatcaagtgagaaggctcattgggaatgagaattatctagactacatgacatcaatgaagagattcaaaaacgagagtgatcctgaaggggcactctggtaa

SEQ ID NO: 6274 - RNA, 9879 nt, synthetic construct
  misc_feature 1..9879: note = derived and/or modified CDS sequence (wt) from DENV-1__KJ755855__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgcccccggatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagagctgaaacgtggatgtcctctgaaggcgcttggaaacagatacaaagagtggagacttgggccctgagacacccaggattcacggtgatagcccttttcctagcacatgccataggaacatccatcacccagaaagggattattttcattttgttaatgctggtaacaccatccatggccatgcgatgtgtgggaataggcagcagggacttcgtggaaggactgtcaggagcaacttgggtagatgtggaactggaacatggaagttgcgtcaccaccatggctaaagacaaaccaacactggacattgaactcttgaagacggaagtcacaaaccctgccgtcctgcgcaaactgtgcattgaagccaaaatatcaaacaccaccactgactcaagatgtccaacacaaggagaagccacattggtggaagaacaggacgcgaactttgtgtgtcgacgaacgtttgtggacagaggctggggcaatggctgtgagctcttcggaaaaggaagcctactaacgtgtgctaagtttaagtgtgtgacaaaactggaaggaaagatagttcaatatgaaaacttgaaatattcagtaatagtcaccgtccacattgccgcccagcatcaggtgggaaatgaaagcacagaacatgggacaactgcaattataacacctcaagctcccacgacggaaatacagctgaccgactacggagctcttacattggattgttcacctagaacaggattagacttcaatgaaatggtgttgttgacaatgaaagaaaaatcatggctagtccacaaacaatggtttctagacttaccactgccttggacctcgggagcttcaacatcacaagagacttggaacagactttttttgttggtgacatttaagacagctcatgcaaagaagcaggaagtagtcgtactaggatcacaagaaggagcaatgcacactgcgttgaccggagcgacagcactccaaacatttggaacgacaacaatttttgcaggacacttgaacattcgactaaagatggacaaactgactctaaaagggatgtcatatgtgatgtgcacaggctcattcaagcttgaaaaagaagtggctgagacccagcatggaaccattctagtgcagattaaatacgaaggaacagatgcaccatgcaagattcctttttcgacccaagatgaaaaaggagtaacccagaatgggagattgataacggccaaccccatagtcactgacaaagaaaaaccagtcaacattgaggcagaaccaccttttggtgagagttacatcgtgataggagcaggtgaaaaagctttgaaactaagctggttcaagaaaggaagcagcataggaaaaatgtttgaggcaactgccagaggagcacgaaggatggccatactgggagacactgcatgggactttggttccataggaggagtgttcacgtctgttggaaaattagtacatcagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaaaggcagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagccactcgtctcgagaacatcatgtggaagcagatttcaaatgaactgaaccacatcttacttgaaaatgacctgaaattcacagtggttgtaggagatgttgctgggatcttggctcaagggaagaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatggggtactggatagaaagtgaaaagaacgagacctggaagctggcaagagcctccttcatagaagttaaaacatgtacttggccaaaatcccacactctatggagcaatggagttctggaaagtgaaatgataattccaaagatctatggaggaccaatatctcagcataactacagcccaggatacttcacacaaacggcagggccgtggcacctaggcaagttggagttggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggtcagtctttcactaggactgctatgcatatcaataatgatcgaagaggtgatgagatccagatggagtagaaaaatgctgatgactggaacactggctgtgttctttcgaaaaataaggggacaattgacatggaatgatctgatcagattatgcatcatggttggagccaacgcttccgacagaatggggacgcgaacaacgtacctagctctgatggccacttttaaaatgagaccaatgttttctgtagggctattattccgcagactaacatccagagaagttcttcttctaaccattggattgagtctagtggcatctgtggagttaccaaattccttggaggagctgggggttttacttgcaatgggcattatgattttaacattattgactgactttcaatcacatcagttgtgggctaccttgctgtccatgacatttatcaaaacaacgttttccttgcactatacatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggacgaagagagagatgacacgctaaccattctccttaaagcaactctgctagcagtttcaggggtgtacccattatcaataccagcgaccctttttgtgtggtacttctggcagaaaaagaaacagagatctggagtgttatgggacacacctagccctccaaaagtggaaaaagcagttcttgatgatggtatctatagaattatgcagagaggactgttgggtaggtcccaagtaggggtaggagtttttcaagaaaacgtgttccatacaatgtggcatgtcaccaggggagctgtactcatgtatcaagggaagagactggaaccgagctggggcagagtcaaaaaagacctgatttcttatggaggaggttgggggcttaaaggatcatggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtcggtctttatggaaatggagtagtgacaacaagtggaacctacgtcagtgccatagctcatgccaaagcatcacaagaagggcccctaccagagactgaagttgaagcattcaggaaaagaaacttaacaataatggacctacatccaggatcgggaaaaacaagaagatatcttccagccatagtccgtgaggccataaaaaggaagatgcgcacactaattctggcccccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcttagccgccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgactttccaggtaaaacagtctggttcgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaacttcccggccgacagggtgatagacccaagacggtgtctgaatccggtaattctaaaagatggtccagagcgcgtcattttagcaggaccgatgccagtgactgtggccagtgccaaccagaggagaggaagaattggaaggaaccacaataaagaaggtgatcagtacatttacatgggacagcctttaaacaacgatgaagatcacgctcactggacagaagcaaaaatgctccttgacaatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaaattacgcccccgctggctggatgccagaacatactcagacccactggccctgcgcgagaaaaaagagtttgcagcaggaagaagaagcgtttcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaagcgggtaacggcctactctgcgtgatggcttcaagcgcactgctatggatggccaatgtggagccccattggatagcggcctccatcatactggagttcttcctaatggtgttgcttattccagagccagacagacaacgcactccgcaggacaaccagctggcatatgtggtgatccgtttgttattcatgatactgacggtagcagccaatgagatgggactgctggaaaccacaaagaaagacttagggattggccatgcggctgttgaaaatcaccaccatgccgcaatgctggacatagacttacatccagcttcagcctggactctctatgcagtggccacaacaattatcactcccatgatgaggcacacaattgaaaacacaacggcaaacatttccctgacagccattgcaaaccaggcagctatattgatgggacttgacaaaggatggcctatatcgaagatggacataggagttccacttctcgccctgggattcctatcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgtccccactttgggaaggatctccaggaaaatcttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagacagaattcaacacctataaaaggagtgggattatggaagtggacagatccgaagccaaagagggactgaaaagaggagaaacaaccaaacatgcagtgtcgagaggaaccgccaaactaaggtggtttgtggagaggaaccttgtgaaaccagaagggaaagtcatagacctcggttgtggaagaggtggctggtcatactattgcgctgggctgaagaaagtctctgaagtgaggggatatacaaaaggaggaccaggacatgaggaaccaatcccaatggcgacctatggatgggacctattaaaacggtgttcggggaaagaatttttttttattccacctgagaaatgtgattcctttttgggtgatattggtgagtcctctccaaacccaactatagaggaaggaagaacggtacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgctaaatcgatttacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactactcaccaaaccatgggatgttatccccatggttacacaaatagccatgactgacaccacaccctttggacaacagagggtgtttaaagagaaagttgacacacgcacaccaaaagcaaaacgaggcacagcacaaatcatggaagtgacagctaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaatcactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgaggaaatcttttcacccaatgaattagagaccccaaatttagccgagagagttctcgactggctggaaaaatatggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctggttatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgccatctgttcagccgttccagttgattgggttccaaccagccgcaccacttggtcgatccatgcccaccaccaatggatgacaacagaagacatgctgtcagtatggaatagggtttggatagaggaaaacccatggatggaggacaaaacccgtgtatctagttgggaagatgttccatacctaggaaaaagggaagatcaatggtgtggatctctgataggcttaacagcaagggccacctgggccaccaacatacaagtggccataaaccaagtgagaagactgattgggaatgagaattattcggattacatgacatcaatgaagagattcaagaacgagagtgaacccgaaggggcactctggtga

SEQ ID NO: 6275 - RNA, 9879 nt, synthetic construct
  misc_feature 1..9879: note = derived and/or modified CDS sequence (wt) from DENV-1__KF289073__SS-prME
  source 1..9879: mol_type = other RNA
tccgtgaccatgctcttcatgctgctgcccacagccctggcgttccatttgaccacacgagggggagagccacacatgatagttagcaagcaggaaagaggaaagtcactcttgtttaagacctctgcaggtgtcaacatgtgcaccctcattgcgatggatttgggagagttatgtgaggacacaatgacctacaaatgcccccggatcactgaggcggaaccagatgacgttgactgctggtgcaatgccacagacacatgggtgacctatgggacgtgttctcaaactggcgaacaccgacgagacaaacgttccgtcgcactggccccacacgtgggacttggtctagaaacaagaaccgaaacgtggatgtcctctgaaggcgcctggaaacaaatacaaaaagtggagacttgggccttgagacacccaggattcacggtgatagccctttttttagcacatgccataggaacatccatcacccagaaagggattattttcattttgctgatgctggtaacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacactggacattgaactcctgaagacggaggtcacgaaccctgccgtcttgcgcaaactgtgcattgaagctaaaatatcaaaaaccaccaccgattcaagatgtccaacacaaggagaagccacactggtggaagaacaagacgcgaactttgtgtgtcgacgaacgttcgtggacagaggctggggtaatggctgtggactattcggaaaaggaagcctactgacgtgtgctaagttcaagtgtgtgacaaaactagaaggaaaaatagttcaatatgaaaacttaaaatattcagtgatagtcaccgtccacactggggaccagcaccaggtaggaaacgagactacagaacatggaacaattgcaaccataacacctcaagctcctacgtcggaaatacagctgaccgactacggagccctcacattggactgctcacctagaacagggctggactttaatgagatggtgctgttgacaatgaaagaaaaatcatggcttgtccacaaacaatggtttctagacttaccactgccttggacctcgggggcttcaacatctcaagagacttggaacagacaagatttgctggtcacatttaagacagctcatgcaaagaagcaggaagtagtcgtactgggatcacaagaaggagcaatgcacactgcgttgactggggcgacagaaatccagacgtcaggaacgacaacaatctttgcaggacacctgaaatgcagactaaaaatggataaactgactttgaaagggatgtcatatgtgatgtgcacaggctcatttaagttagagaaggaagtggctgagacccagcatggaaccgtcttagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcttgttcagcggtgtttcctggaccatgaaaataggaataggggttctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaaatgtggaagtggcatttttgtcactaatgaagtccacacttggacagagcaatacaaattccaggctgactccccaaaaagactgtcagcagccattgggaaggcatgggaggagggcgtgtgtggaattcgatcagccacacgtcttgagaacatcatgtggaagcaaatatcaaatgaattgaaccacattctacttgaaaatgacatgaaattcacagtggttgtaggagatgctaatggaatcttggcccaaggaaaaaaaatgattaggccacaacccatggaacacaaatactcatggaaaagctggggaaaagccaaaatcataggggcagacatacagaataccaccttcatcatcgacggcccagacactccagaatgccccgatgaccacagagcatggaacatttgggaagttgaggactatgggtttggaattttcacgacaaacatatggctgaaactgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtcaagacatgcatctggccaaaatcccacactctatggagtaatggagttttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccatctcttagaactacaacagtcacaggaaagataatccatgaatggtgctgcagatcctgcacgttaccccccttacgcttcaaaggagaagacggatgttggtatggcatggaaatcagaccagttaaggagaaggaagagaacctagtcaggtcaatggtctctgcagggtcaggagaagtggatagtttttcattaggactactatgcgtatcaataatgattgaagaagtgatgagatccagatggagtagaaagatgctgatgactggaacattggctgttttcctccttcttataatgggacaactgacatggaatgatctgatcaggttatgcatcatggttggagccaatgcttcagacaggatggggatgggaacaacgtacctagccttgatggccactttcaaaatgagaccaatgttcgctgttgggctattatttcgcagactaacatccagagaagttcttcttctcacaattggattaagcctggtggcatccgtggagctaccaaattctttagaggagctaggggatggacttgcaatgggcatcatgatgttaaaattattgactgattttcaatcacaccagttatggactaccttactgtctctgacatttatcaaaacaactctttcattggattatgcatggaagacaatggctatggtactgtcaatcgtatctctctttcctttatgtctgtctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagttagtattctactaagttcactcctcaaaaatgatgtgccgctagccggcccactaatagctggaggcatgctaatagcatgttatgtcatatccggaagctcagccgatttatcattggagaaagcggctgaggtctcctgggaagaagaagcagaacactctggtgcctcacacaacatattagtggaggtccaagatgatggaactatgaaaataaaagatgaagagagagatgacacactcaccatactccttaaagcaactctgctggcagtctcaggggtgtacccaatgtcaataccagcaaccctttttgtgtggtatttttggcagaaaaagaaacagagatcaggagtgttatgggacacacccagccctccagaagtggaaagagcagttcttgatgatggtatctatagaatcttgcaaagaggactgttgggcaggtcccaagtaggagtgggagttttccaagacggcgtgttccacacaatgtggcacgtcaccaggggagctgtcctcatgtaccaagggaagaggctggaaccaagctgggccagtgtcaaaaaagacttgatctcatatggaggaggttggaggtttcaaggatcatggaacatgggagaagaagtgcaggtgatagctgttgaaccaggaaaaaaccccaaaaatgtacagacaacgccgggcaccttcaagacccccgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaagaagggcctctaccagagattgaggacgaggtgtttaggaaaagaaacttaacaataatggacctacatccaggatcaggaaaaacaagaagatatcttccagccatagtccgtgaggccataaaaaggaagctgcgcacgctaatcttggctcccacaagagttgtcgcctctgaaatggcagaggcgctcaagggaatgccaataagatatcagacaacagcagtaaagagtgaacacacaggaagggagatagttgacctcatgtgccacgccactttcaccatgcgtctcttatctccagtgagagttcccaattacaacatgatcatcatggatgaagcacattttactgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgatttcccaggtaaaacagtctggtttgttccaagcatcaaatcaggaaatgacattgccaactgtttaagaaagaacggaaaacgggtgatccaattgagcagaaaaacctttgacactgagtaccagaaaacaaaaaacaatgactgggactatgttgtcacaacagacatttccgaaatgggagcaaatttccgggccgacagggtaatagacccaaggcggtgcttgaaaccggtaatactaaaagatggtccagagcgcgtcattctagccggaccgatgccagtgactgtggccagtgctgcccagaggagaggaagaattggaaggaaccaaaacaaggaaggtgatcagtatgtttacatgggacagcctttaaataatgatgaggaccacgctcattggacagaagcaaaaatgctccttgacaatataaacacaccagaagggattatcccagccctctttgagccggagagaaaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattacgaccccgctggctggatgccagaacatactctgatccattggccctgcgcgagtttaaagagtttgcagcaggaagaaggagtgtctcaggtgacctaatattagaaatagggaagcttccacaacatttgacgttaagggcccagaaagctttggacaacttggtcatgttgcacaactccgaacaaggaggaaaagcctatagacatgccatggaagaactaccagacaccatagaaacattgatgctcctagctttgatagctgtgctgactggtggagtgacgctgttcttcctatcaggaaaaggtctagggaaaacatccattggcctactttgtgtgatggcctcaagcgcactgttatggatggccagtgtggaaccccattggatagcggcctccatcatactagagttctttctgatggtgctgctcattccagagccagacagacagcgcactccacaggacaaccagctagcatatgtggtgataggtttgttattcatgatattgacagtggcagccaatgagatgggattattggaaaccacaaagaaagacctggggattggccatgtagctgccgaaaaccaccaccatgctacaatgctggacgtagacctacgtccagcttcagcctggaccctctatgcagtagccacaacaattatcactcccatgatgagacacacaattgaaaacacaacggcaaatatttccctgacagccattgcaaatcaggcagctatattgatgggacttgacaagggatggccaatatcgaagatggacataggagtcccacttctcgccttagggtgctattcccaggtgaacccattgacactgacagcggcggtgttgatgctagtggctcattatgccataattggaccaggactgcaagcaaaggctactagagaagctcaaaaaaggacagcggccggaataatgaaaaatccaactgtagacgggattgttgcaatagacttggatcctgtggtttacgatgcaaaatttgaaaaacagctaggccaaataatgttactgatactttgcacatcacagattctcttgatgcggaccacatgggccttgtgtgaatcaatcacactggctactggacccttgaccactctttgggagggatctccaggaaaattctggaataccacgatagcagtgtccatggcaaacatcttcaggggaagttatctagcaggagcaggtctggccttctcattgatgaaatctttaggaggaggtaggagaggtacaggagctcaaggggaaacactgggagaaaaatggaaaagacagctaaaccaactgagcaagtcagaattcaacacttacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcacagaagtgaagggatatacaaaaggaggacctggacatgaggaacctatcccaatggcgacttatggatggaacctagtgaagctacactctggaaaagatgtgttctttacaccacctgagaaatgtgacacccttttgtgtgatattggtgagtcctctccgaatccaactatagaagaaggaagaacgttacgtgttctaaagatggtggaaccatggctcagaggaaaccagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatgactcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggcgtggtgagattgctcaccaaaccatgggatgttatccccatggtcacacaaatagctatgactgataccacacccttcggacaacagagggtgtttaaagagaaagttgacacgcgcacaccaagagcaaaacgaggcacagcacaaattatggaggtgacagccaagtggttatggggtttcctttctagaaacaaaaaacccagaatctgcacaagagaggagttcacaagaaaagttaggtcaaacgcagcaattggagcagtgttcgttgatgaaaaccaatggaactcagcaaaagaagcagtggaagacgaaaggttttgggatctcgtgcacagagagagggagcttcataaacagggaaaatgtgccacgtgtgtctacaatatgatggggaagagagagaaaaaattaggagagtttggaaaggcaaaaggaagtcgtgcaatatggtacatgtggttgggagcacgctttctagagttcgaagcccttggtttcatgaatgaagatcactggttcagtagagagaattcactcagtggagtggaaggagaaggactacacaaacttggatacatactcagagacatatcaaagattccagggggaaatatgtatgcagatgatacaaccggatgggacacaagaataacagaggatgaccttcagaatgaggctaaaatcactgacatcatggagcccgaacatgctctattggctacgtcaatctttaagctgacctaccaaaataaggtggtaagggtgcaaagaccagcaaaaagtggaaccgtgatggatgttatatccagacgtgaccagagaggaagtggacaggtcggaacttatggcttaaatacattcaccaacatggaggtccaactaataagacaaatggagtctgagggaatctttttacccagcgaattggaaacccctaatctagctgagagagttctcgactggttggaaaaacatggcgtcgaaaggctgaaaagaatggcaattagcggagatgactgtgtggtgaaaccaactgatgacaggttcgcaacagccttaacagctctgaatgacatgggaaaagtaagaaaagacataccgcaatgggaaccttcaaaaggatggaatgactggcagcaagtgcctttctgttcacaccatttccaccagctgatcatgaaggatgggagggagatagtggtgccatgccgcaaccaagatgaacttatgggcagggccagagtatcacaaggcgccggatggagcctgagagaaactgcttgcctaggcaagtcatatgcacaaatgtggcagctgatgtacttccacaggagagacctgagattagcggctaatgctatctgttcagccgtcccagttgattgggtcccaaccagccgcaccacctggtcgatccatgcccaccaccaatggatgacaacagaagacatgttgtcagtatggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 6276 - RNA, 9879 nt, synthetic construct
  misc_feature 1..9879: note = derived and/or modified CDS sequence (wt) from DENV-1__JQ915072__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaaggaattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaattgtgtatagaagctaaaatatcaaatactaccactgactcgagatgtccgacacaaggagaagccacgctggtggaagaacaagacacgaactttgtgtgtcgacgaacattcgttgacagaggctggggcaatggttgtggactattcggaaagggtagcctaataacgtgtgctaagttcaagtgtgtgacaaaattggaaggaaagatagtccaatatgaaaacttaaaatattctgtgatcgttactgtccacactggagaccagcaccaagttggaaatgagaccacagaacatggaacaatagcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgtgattcctacacccaagtgtgtgaccatcgactaatgtcggctgccatcaaggatagcaaagcagttcatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggacatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctctgatggccactttcagaatgagaccaatgttcgcagtcgggctattatttcgcagattaacatctagagaagttctccttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagtcttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacatgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtctaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggtcatactgaaagatggtccagagcgtgtcattctagccggaccgatgccagtgactgtggctagtgccgcccagaggagaggaagaattggaaggaaccaaaataaggaaggcgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacccgtctggctatcttacaaagtcgcctcagaaggcttccaatactccgacagaagatggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgactggcggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgctcattccagagccagatagacagcgcactccacaagacaaccagttagcatatgtggtgataggcttgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctttacgcagtggccacaacgattatcactcccatgatgagacacacaattgaaaacacaacggcaaatatttccctgacagctattgcaaaccaggcagctatattgatgggacttgataagggatggccgatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggcagttatctagcaggagcgggtctggccttttcattaatgaaatctctgggaggaagtaggagagggacgggagcccaaggggaaacattgggagaaaagtggaaaagacagctgaaccaattgagcaagtcagaatttaacatttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacttatggatggaatctagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgctagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacataaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtttacaacatgatgggaaagagagaaaaaaaattaggagagttcggaaaggcaaaaggaagtcgcgcaatatggtacatgtggctgggagcgcgcttcttagagtttgaagcccttggcttcatgaatgaagatcactggttcagcagagagaattcactcagtggagtggagggagaaggactccacaaacttggatacatacttagagatatatcaaagattccagggggaaatatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaactccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcagtgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatttgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagttgggaagacgttccatacctagggaaaagggaagatcaatggtgtggatccctaataggcttaacagcacgagccacctgggccaccaacatacaggtggccataaaacaagtgagaaggctcattgggaatgagaattatctagactacatgacatcaatgaagagattcaaaaacgagagtgatcctgaaggggcactctggtaa

SEQ ID NO: 6277 - RNA, 9879 nt, synthetic construct
  misc_feature 1..9879: note = derived and/or modified CDS sequence (wt) from DENV-1__JQ915071__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaaggaattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaatactaccactgactcgagatgtccgacacaaggagaagccacgctggtggaagaacaagacacgaactttgtgtgtcgacgaacattcgttgacagaggctggggcaatggttgtggactattcggaaagggtagcttaataacgtgtgctaagtttaagtgtgcgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcacggaactgttctagtacaggtcaaatacgaaggaacagatgcaccatgcaagatccccttctcgtcccaagatgagaagggagtaacccagaatgggagattggtaacagccaaccccatagtcactgacaaagaaagaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtctctttcaatgacgtgtatcgcagttggcatggtcacactgtacctaggagtcatggtccaggcggactcgggatgtgtaatcaactggaaaggcagagaactcaaatgtggaagtggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgtgattcctacacccaagtgtgtgaccatcgactaatgtcggctgccatcaaggatagcaaagcagttcatgctgacatggggtactggatagaaagtgaaaagaacgagacttggaagttggcaagagcctctttcatagaagtcaagacatgcgtttggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcggggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttctccttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgatacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggatcacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaagatggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaagtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgactggcggagtgacgctgttcttcctatcaggaagaggcttagggaaaacatccataggcctactctgcgtgacgtcctcaagtgcactgttatggatggccaatgtggagccccattggatagcggcctctattatactagagttctttctgatggtgttgctcattccagagccagatagacagcgcactccacaagacaaccagttagcatatgtggtgataggtttgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacctacaagaggagtgggattatagaagtagatagatctgaagccagggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaatttagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaaggaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgccacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagttgggaagacgttccatacctagggaaaagggaagatcaatggtgtggatccctaataggcttaacagcacgagccacctgggccaccaacatacaggtggccataaaccaagtgagaaggctcattgggaatgagaattatctagactacatgacatcaatgaagagattcaaaaacgagagtgatcctgaaggggcactctggtaa

SEQ ID NO: 6278 - RNA, 9879 nt, synthetic construct
  misc_feature 1..9879: note = derived and/or modified CDS sequence (wt) from DENV-1__JQ915073__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttttcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaaggaattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaacactaccactgactcgagatgtccgacacaaggagaagccacgctggtggaagaacaagacacgaactttgtgtgtcgacgaacattcgttgacagaggctggggcaatggttgtggactattcggaaagggtagcttaataacgtgtgctaagtttaagtgtgtgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgtgattcctatacccaagtgtgtgaccatcgactaatgtcggctgccatcaaggatagcaaagcagttcatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggacatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtgatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttctcctcctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagtcttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacaacgccaggtaccttcaagacttctgaaggcgaagtcggagccatagctctagacttcaaacccggcacatctggatctcctatcgtgaacagagagggaaaaatagtaggtctttacggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggcggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggtcatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaagatggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattggaaatagggaaacttccacaacatctcacgcaaagggcccagaatgctttggataatctggttatgctgcacaactctgaacaaggaggaaaagcttatagacacgccatggaagaattgccagacaccatagagacaataatgcttctagctctgatagctgtgctgactggcggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgctcattccagagccagatagacagcgcactccacaagacaaccagttagcatatgtggtgataggtctgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtggccacaacgattatcactcccatgatgagacacacaattgaaaacacaacggcaaatatttccctgacagctattgcaaaccaggcagctatattgatgggacttgataagggatggccgatatcaaagatggacataggagttccactcctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaatctagtaaagctacactccgggaaagatgtattctttataccacctgagaaatgtgacactcttttgtgtgatataggtgagtcttctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacataaatcaacatggcattatgatgaggataatccgtacaagacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgctacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatacttagagatatatcaaagattccagggggaaacatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcagtgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatttgttcagccgttccagttgattgggtcccaaccagtcgcaccacctggtcgatccatgcccaccatcaatggatgacaacagaagacatgttgtcagtgtggaatagggtctggatagaggaaaacccatggatggaggacaaaactcatgtgtccagttgggaagacgttccatacctagggaaaagggaagatcaatggtgtggatccctaataggcttaacagcacgagccacctgggccaccaacatacaagtggctataaaccaagtgagaaggctcattgggaatgagaattatctagactacatgacatcaatgaagagattcaaaaacgagagtgatcctgaaggggcactctggtaa

SEQ ID NO: 6279 - RNA, 9879 nt, synthetic construct
  misc_feature 1..9879: note = derived and/or modified CDS sequence (wt) from DENV-1__JQ915075__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaaggaattatcttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaatactaccactgactcgagatgtccgacacaaggagaagccacgctggtggaagaacaggacacgaactttgtgtgtcgacgaacattcgttgacagaggctggggcaatggttgtggactattcggaaagggtagcttaataacgtgtgctaagtttaagtgtgcgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgtagattaaaaatggacaaactaactctaaaaggaatatcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaagaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtctctttcaatgacgtgtatcgcggttggcatggtcacactgtacctaggagtcatggtccaggcggactcgggatgtgtaatcaactggaaaggcagagaactcaaatgtggaagtggcatttttgtcactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgtgattcctacacccaagtgtgtgaccatcgactaatgtcggctgccatcaaggatagcaaagcagttcatgctgacatggggtactggatagaaagtgaaaagaacgagacttggaagttggcaagagcctctttcatagaagtcaagacatgcgtttggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgcggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcggggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttctccttctcacggttggattgagtctggtggcatctgtagaactaccaaattccttagacgagttaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcttccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggcatcttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcggacgttagttctggctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcttttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtaccagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggatcacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaagatggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaagtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgaccggcggagtgacgctgttcttcctatcaggaagaggcttagggaaaacatccataggcctactctgcgtgacgtcctcaagtgcactgttatggatggccaatgtggagccccattggatagcggcctctattatactagagttctttctgatggtgttgctcattccagagccagatagacagcgcactccacaagacaaccagttagcatatgtggtgataggtttgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtggccacaacgattatcactcccatgatgagacacacaattgaaaacacaacggcaaatatttccctgacagctatggcaaaccaggcagctatattgatgggacttgacaagggatggccaatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacacctacaagaggagtgggattatagaagtagatagatctgaagccagggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacctatggatggaatttagtaaagctacactccgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattttaaatccctatatgccgagtgtggtagaaactctggagcaaatgcaaaggaagcatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccgaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgccacatgcgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggaagatcttcagaatgaggccaaaattactgacatcatggaacctgaacatgccctactggccacgtcaatctttaagctaacctaccaaaataaggttgtaagggtacagagaccagcaaaaaacggaaccgtgatggatgtcatatccaggcgtgaccagagaggaagtggacaggttggaacttatggcttaaacaccttcaccaacatggaggcccaactaataagacaaatggagtctgaaggaatcttttcacctagcgaattggaaaccccaaatttagccggaagagtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcaatgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcacaaatgtggcagctgatgtacttccacagaagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagttgggaagacgttccatacctagggaaaagggaagatcaatggtgtggatccctaataggcttaacagcacgagccacctgggccaccaacatacaggtggccataaaccaagtgagaaggctcattgggaatgagaattatctagactacatgacatcaatgaagagattcaaaaacgagagtgatcctgaaggggcactctggtaa

SEQ ID NO: 6280 - RNA, 9879 nt, synthetic construct
  misc_feature 1..9879: note = derived and/or modified CDS sequence (wt) from DENV-1__JQ915076__SS-prME
  source 1..9879: mol_type = other RNA
tctgtgaccatgctcctcatgctgctgcccacagtcctgacgttccatttgaccacccgagggggagagcctcacatgatagttagcaaacaggaaagaggaaagtcacttttgttcaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacgtgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacttgggctctgagacacccaggatttacggtgatagccctttttctagcacatgccataggaacatccatcacccagaaaggaattattttcattttgctgatgctggtgactccatccatggccatgcggtgcgtgggaataggaaacagagacttcgtggaaggactgtcaggagctacgtgggtggatgtagttctggagcatggaagttgcgtcactaccatggcaaaagacaaaccaacactggacattgaactcctgaagacggaggtcacaaatcctgccgtcctgcgcaaactgtgtatagaagctaaaatatcaaatactaccactgactcgagatgtccgacacaaggagaagccacgctggtggaagaacaagacacgaactttgtgtgtcgacgaacattcgttgacagaggctggggcaatggttgtggactattcggaaagggtagcttaataacgtgtgctaagttcaagtgtgtgacaaaattggaaggaaagatagtccaatatgaaaacttaaaatattctgtgatcgttactgtccacactggagaccagcaccaagttggaaatgagaccacagaacatggaacaattgcaaccataacaccccaagctcccacgtcggaaatacaactgacagactacggagctctaacactggattgttcacctagaacagggctagactttaatgagatggtgttgctgacaatgaaagaaaaatcatggctcgtccacaaacaatggtttctagacttaccactgccttggaccacaggggcttcaacgtcccaagagacctggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatgtcatatgtaatgtgcacaggctcattcaagttagagaaggaagtggctgagacccagcatggaactgttctagtacaggtcaaatacgaaggaacagatgcaccatgcaagatccccttctcgtcccaagatgagaagggagtaacccagaatgggagattggtaacagccaaccccatagtcactgacaaagaaaaaccagtcaacattgaagcggagccaccctttggtgagagctacatcgtggtaggagcaggtgaaaaagctttgaaactaagttggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagtcggcatggtcacactgtacctaggagtcatggtccaggcggactcgggatgtgtaatcaactggaaaggcagagaactcaaatgtggaagcggcatttttgtcaccaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaactaaaccacatcttacttgaaaatgacatgaaatttacagtggtagtaggagacgttagtggaatcttggcccaaggaaagaaaacgattaggccacaacccatggaacacaaatactcgtggaaaagctggggaaaagccaaaatcattggagcagatgttcagaacactaccttcatcatcgacggcccaaacaccccagaatgccccgatgaccaaagagcgtggaacatctgggaagttgaagactatggatttggaattttcacgacaaacatatggttgaaattgcgtgattcctacacccaagtgtgtgaccatcgactaatgtcggctgccatcaaggatagcaaagcagttcatgctgacatggggtactggatagaaagtgaaaagaacgagacttggaagttggcaagagcctccttcatagaagtcaagacatgcgtctggccaaaatctcacactctatggagcaatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggacatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgttatgcatatcaataatgatcgaagaggtaatgagatccagatggagcaggaaaatgctgatgactggaacattggttgtgttcctccttctcacattgggacaattgacatggaacgatctgatcaggctatgcataatggttggagccaatgcttcagacaatatggggatgggaacaacatacttagctttgatggccactttcagaatgagaccaatgttcgcagtcgggctattatttcgcagattaacatctagagaagttctccttctcacggttggattgagtctggtggcatctgtagaactaccaaattccttagacgagctaggggatggacttgcaatgggcatcatgatattgaaattactgactgattttcaatcacatcagctatgggccactttgctgtctctaacatttgtcaaaacaactctttcactgcactatgcatggaagactatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcacaatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagtcttccaagaaggcgtattccacacaatgtggcacgtcaccaggggagctgtcctcatgtaccaagggaagagattggaaccaagttgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtactttcaagacttctgaaggcgaagttggagccatagctctagacttcaaacccggcacatctggatctcctatcgtgaacagagagggaaaaatagtaggtctttacggaaatggagtggtgacaacaagtggaacctatgtcagtgctatagctcaagctaaaacatcacaagaagggcctttgccagagattgaggacgaggtgtttaggaaaagaaacttaacaataatggatctacacccaggatcgggaaaaacaagaagataccttccagccatagtccgtgaggccataaaaagaaagctgcggacgttagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataatcatggatgaagcacattttaccgatccagccagcatagcagccagagggtacatctcaacccgagtgggtatgggtgaagcagctgcgattttcatgacagccaccccccccggatcggtggaggcttttccacagagcaatgcagttatccaagatgaggaaaaagacattcctgaaagatcatggaactcaggctatgactggatcactgactttccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggtcatactgaaagatggtccagagcgtgtcattctagccggaccgatgccagtgactgtggctagtgccgcccagaggagaggaagaattggaaggaaccaaaataaggaaggtgatcagtatgtttacatgggacagcctctaaataatgatgaggaccacgcccattggacagaagcaaaaatgctccttgacaacataaacacaccagaagggatcatcccagccctctttgagccggaaagagaaaagagtgctgcaatagacggggagtacagactacggggtgaagcgaggaaaacgtttgtggagctcatgagaagaggagatctacccgtctggctatcttacaaagtcgcctcagaaggcttccaatactccgacagaagatggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattggaaatagggaaacttccacaacatctaacgcaaagggcccagaatgctttggataatctggttatgctgcacaactctgaacaaggaggaaaagcttatagacacgccatggaagaattgccagacaccatagagacaataatgctcctagctctgatagctgtgctgactggcggagtgacgctgttcttcctatcaggaagaggcttagggaaaacatccataggcctactctgcgtgacgtcctcaagtgcactgttatggatggccagtgtggagccccattggatagcggcctctattatactagagttcttcctgatggtgttgctcattccagagccagatagacagcgcactccacaagacaaccagttagcatatgtggtgataggcttgctattcatgatattgacagtggcagccaatgagatgggattattggaaaccacaaagaaagacctggggattggtcatacagctgctgaaaaccaccaccacgccgcaatgttggacgtggacctccatccagcttcagcctggaccctctacgcagtggccacaacgattatcactcccatgatgagacacacaattgaaaacacaacggcaaatatttccctgacagctattgcaaaccaggcagctatattgatgggacttgacaagggatggccgatatcaaagatggacataggagttccacttctcgccttggggtgctattctcaagtgaacccgctgacgctgacagcagcggtactgatgctagtagcccattatgccataattggaccaggactgcaagcaaaagccactagagaagcgcaaaaaaggacggcagccggaataatgaaaaacccaactgtcgacgggatcgttgcaatagatttagaccctgtggtttatgatgcaaaatttgaaaaacagctaggccaaataatgttgctgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaacatttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatacacaaaaggaggacctggacatgaggaaccgatcccaatggcaacttatggatggaatctagtaaagctacactctgggaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccgattcacaatggctcacaggaagccaacatatgaaagagatgtggacttgggcgctggaacgagacatgtggcagtagaaccagaggtggccaacctagacatcattggccagaggatagagaacataaaaaatgaacataaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagtcaggtcaaatgcagctattggagcagtgttcgttgatgaaaatcaatggaactcagcaaaagaagcagtggaagatgaaaggttctgggaccttgtgcgcagagagagggagcttcataaacaaggaaaatgtgccacatgtgtctacaacatgatgggaaagagagaaaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatacttagagatatatcaaagattccagggggaaatatgtatgcagatgacacagccggatgggacacaagaataacagaggaagatcttcagaacgaggccaaaattactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaagggatcttttcacctagcgaattggaaactccaaatttagccggaagggtccttgactggttggaaaaacatggcatcgagaggctgagaagaatggcaatcagtggagatgactgtgtggtgaaaccaattgatgacagatttgcaacagccttaacagccttgaatgacatgggaaaggtaagaaaagacataccgcagtgggaaccttcaaaaggatggaatgattggcaacaagtgcccttctgctcacaccacttccaccagctgattatgaaggatgggagggagatagtggtgccatgccgcaaccaagatgaattggtaggtagggccagagtgtcacaaggcgccggatggagcttgagagaaactgcatgtctaggcaagtcgtatgcgcaaatgtggcagctgatgtacttccacagaagagacttgagactagcggctaatgctatttgttcagccgttccagttgattgggtcccaaccagtcgcaccacctggtcgatccatgcccaccatcaatggatgacaacagaagacatgttgtcagtgtggaacagggtctggatagaggaaaacccatggatggaggataaaactcatgtgtccagttgggaagacgttccatacctagggaaaagggaagatcaatggtgtggatccctaataggcttaacagcacgagccacctgggccaccaacatacaggtggccataaaccaagtgagaaggctcattgggaatgagaattatctagactacatgacatcaatgaagagattcaaaaacgagagtgatcctgaaggggcactctggtaa

SEQ ID NO: 6281 - RNA, 9879 nt, synthetic construct
  misc_feature 1..9879: note = derived and/or modified CDS sequence (wt) from DENV-1__KF289072__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcctgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgctctgtcgcattggccccacacgtggggcttggtctcgaaacaagaaccgaaacgtggatgtcctctgaaggcgcctggagacagatacaaaaagtggagacttgggccttgagacacccaggattcacggtgatagccctttttctagcacatgccataggaacatccattacccagaaagggatcatcttcattttgctgatgctggtgacaccatcaatggccatgcgatgtgtgggaataggcaacagagacttcgttgaaggactgtcaggagcaacatgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccactaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatttgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgttttagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcttgttcagcggtgtttcctggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatataaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaatttacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgacggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgttgcagatcctgcacgctaccccccttacgcttcaaaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagccttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctctcactggattatgcatggaagacaatggctatggtattgtcaatcgtatctctctttcctctatgtctatccacgacctctcaaaaaacaacatggcttccggtgctgctaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgatacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccatacaatgtggcatgtcaccaggggggccgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaagaatgtacagacaacgccgggcaccttcaagacccctgaaggcgcagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgctcaaaggaatgccaataagatatcagacaacagcagtaaagagtgaacacacaggaaaggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctatgactggatcactgatttcccaggaaaaacagtctggtttgttccaagcatcaaatcaggaaatgacattgccaactgtttaagaaaaaacgggaaacgggtgatccaattgagcagaaaaacctttgacactgaataccagaaaacaaaaaacaatgattgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgactgcggccagtgctgcccagaggagaggaagaattggaaggaaccaaaacaaagaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtacagactgcggggagaagcaaggaaaacgttcgtggagctaatgagaagaggggatttaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcctatagacatgctatggaagaactaccagacaccatagaaacattgatgctactagctttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggcccattatgccataatcggacctggactgcaagcaaaagctactagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatccatcacactggctactggacccttgaccactctctgggagggatctcctggaagattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggaaggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgcgctgggctgaagaaggtcacagaagtgaagggatacacaaaaggaggacctggtcatgaggaacctatcccaatggcgacttatgggtggaacatagtgaagctacactctggaagggatgtgttctttacaccacctgagaaatgtgacacccttttgtgtgatattggtgagtcctctccgaatccaactatagaagaaggaagaacgttacgtgttctaaagatggtggaaccatggctcagaggaaaccagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatgactcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgtcatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatttgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatggggaaaagagagaaaaaactaggagagtttggaaaggcaaaaggaagtcgtgcaatatggtacatgtggttgggagcacgctttctagagtttgaagcccttggcttcatgaatgaagaccactggttcagtagggagaattcactcagtggagtggaaggagaaggactacataaacttggatacatacttagagacatatcaaagattccagggggaaatatgtatgcagacgacacagctggatgggacacaagaataacagaggatgatcttcagaatgaggctaaaatcaccgacatcatggagcccgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggtttgcaacagctttaacagccctgaatgacatgggaaaggtgagaaaagacataccgcaatgggaaccttcaaaaggatggaatgactggcagcaagtgcctttctgttcacaccacttccaccaactgatcatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggccaatgctatctgttcagccgttccagttgattgggtcccaaccagccgcaccacttggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgattccgaaggagccctctggtaa

SEQ ID NO: 6282 - RNA, 9879 nt, synthetic construct
  misc_feature 1..9879: note = derived and/or modified CDS sequence (wt) from DENV-1__JQ692085__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggagacagatacaaaaagtggagacttgggccttgagacacccaggattcacggtgatagccctttttctagcacatgccataggaacatccattacccagaaagggatcatcttcattttgctgatgctggtgacaccatcaatggccatgcgatgtgtgggaataggcaacagagacttcgttgaaggactgtcaggagcaacatgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccactaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcttagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcttgttcagcggtgtttcctggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatataaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaatttacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgacggcccagatactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgttgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagccttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcgatcgtatctctctttcctctatgtctatccacgacctctcaaaaaacaacatggcttccggtgctgttaggatcctttggatgtaaaccactaaccatgtttcttataacagaaaacaaaatttggggaaggaaaagttggcccctcaatgaaggaattatggctgttggaatagtcagcattttattaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgatacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaagaatgtacagacaacgccgggcaccttcaagacccctgaaggcgcagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgctcaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctatgactggatcactgatttcccaggaaaaacagtctggtttgttccaagcatcaaatcaggaaatgacattgccaactgtttaagaaaaaacgggaaacgggtgatccaattgagcagaaaaacctttgacactgaataccagaaaacaaaaaacaatgattgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgcggccagtgctgcccagaggagaggaagaattggaaggaaccaaaacaaagaaggtgaccagtatatttacatgggacagcctttaaataatgatgaggaccacgcccattggacagaagcaaaaatgctccttgacaatataaatacgccagaagggattatcccagccctctttgagccagagagagaaaagagtgcagcaatagacggggagtacagactgcggggagaagcaaggaaaacgttcgtggagctaatgagaagaggggatttaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggcccattatgccataatcggacctggactgcaagcaaaagctactagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatccatcacactggctactggacccttgaccactctctgggagggatctcctggaagattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggaaggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaaccagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaaccggttcacaatgactcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatataaaacatgggcctatcatggatcatatgaggtcaagccatcagggtcagcctcatccatggtgaatggcgtggtgagattgctcaccaagccatgggatgtcatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatttgcacaagagaggagttcacaagaaaagttaggtcaaacgcagcagttggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatggggaaaagagagaaaaaactaggagagtttggaaaggcaaaaggaagtcgtgcaatatggtacatgtggttgggagcacgctttctagagtttgaagcccttggcttcatgaatgaagaccactggttcagtagggagaattcactcagtggagtggaaggagaaggactacataaacttggatacatacttagagacatatcaaagattccagggggaaatatgtatgcagacgacacagctggatgggacacaagaataacagaggatgatcttcagaatgaggctaaaatcaccgacatcatggagcccgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccaacgaattggaaaattcaaatctagctgagagagttctcgactggttggaaaaacatggcgtcgaaaggttgaaaagaatggcaatcagcggagatgactgtgtggtgaaaccaactgatgacaggtttgcaacagctttaacagccctgaatgacatgggaaaggtgagaaaagacataccgcaatgggaaccttcaaaaggatggaatgactggcagcaagtgcctttctgttcacaccacttccaccaactgatcatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggccaatgctatctgttcagccgttccagttgattgggtcccaaccagccgcaccacttggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgattccgaaggagccctctggtaa

SEQ ID NO: 6283 - RNA, 9879 nt, synthetic construct
  misc_feature 1..9879: note = derived and/or modified CDS sequence (wt) from DENV-1__JQ917404__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggagacagatacaaaaagtggagacttgggccttgagacacccaggattcacggtgatagccctttttctagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagccctcacattggactgctcacctagaacagggctggactttaatgagatggtgctgctgacaatgaaagaaaaatcatggcttgtccacaaacaatggtttctagacttaccattgccttggacctcgggggcttcaacatctcaagagacttggaacagacaagatctgctagtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgttttagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatataaatttcaggctgactccccaaaaagactatcagcagccattgggaaggcatgggaggaaggcgtgtgtggaattcgatcagccacacgtcttgagaacatcatgtggaagcaaatatcaaatgaattgaaccacatcctacttgaaaatgacatgaaattcacagtggttgtaggagacgccaatggaatcttgacccaaggaaaaaagatgattaggccacaacccatggaacacaaatattcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctctgatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgctgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgacagggtaatagacccaaggcggtgcttgaagccggtaatactaaaagatggcccagagcgcgtcattctagccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaagagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttgatgttagtggctcattatgccataatcggacctggactgcaagcaaaagctactagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggagcaggtctggccttctcattaatgaaatctttaggaggaggtaggagaggtacgggagctcaaggggaaacattgggagaaaaatggaaaagacaattaaaccaactgagcaagtcagaatttaacacttacaaaaggagtggaattatggaggtggacagatctgaagccaaggagggactgaaaagaggagaaacaaccaaacatgcagtgtcgagaggaacagccaaacttagatggtttgtggagaggaaccttgtgaaaccagaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacattgtgtcggcagtgaacatgacatccagaatgttgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatggggaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaactcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgatcccgaaggagccctctggtaa

SEQ ID NO: 6284 - RNA, 9879 nt, synthetic construct
  misc_feature 1..9879: note = derived and/or modified CDS sequence (wt) from DENV-1__GU370048__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgtaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcactcagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacactaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcatcaggtgggaaatgaaagcacagaacatgggacaactgcaactataacacctcaagctcccacgacagaaatacagctgaccgactacggagctcttacattggattgttcacctagaacaggactaaactttaatgaaatggtgttgttgacaatgaaagaaaaatcatggctagtccacaaacaatggtttctagacctaccactgccttggacctcgggagcctcaacaacacaagaaacttggaacagacaagatttgctggtgacatttaagacagctcatgcaaagaagcaggaagtagtcgtactaggatcacaagaaggagcaatgcacactgcgctgaccggagcgacagaaatccaaacatctggaacgacaacaatttttgcaggacacttgaaatgtagactaaagatggacaaactgactctaaaagggatgtcatatgtgatgtgcacaggctcattcaagctagagaaggaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggttctgttgacatggctaggattaaactcaaggagcacgtccctttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaggagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaaggaaaaaaaatgattaggccacaacccatggaacacaaatactcgtggaaaagctggggaaaggctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccattaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacagcagggccgtggcacctaggcaagctggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctccgcagggtcaggggaagtggacagcttttcactaggactgttatgcatatcaataatgatcgaagaggtgatgagatccagatggagtagaaaaatgctgataactggaacactggctgtgttcttccttctcataatgggacaagtgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaaccacatcagctatgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaattgtcagcatcctactaagttcactcctcaaaaatgatgtgccgctagctggaccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgctatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgaccagtacatctacatgggacagcctttaaacaacgatgaagatcacgcccactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgctagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactaccagacaccatagaaacgttgatgctcctagctttgatagctgtgttaactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatcttgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcaaaagctactagggaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattaatgaaatccctaggaggaggtaggagaggcacgggagcccaaggggaaacactgggagagaaatggaaaagacagctgaaccaattgagcaagtcagaattcaacacctataaaaggagtgggattatggaagtggacagatccgaagccaaagagggactgaaaagaggagaaacaaccaagcatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatatacaaaaggaggacctggacatgaagaaccaatcccaatggcgacctatggatggaacctagtaaagctgcactctgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacaccacaccctttggacaacagagggtgttcaaagagaaagttgacacacgcacaccaaaagcaaagcgaggcacagcacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggctaaaattactgacatcatggaacccgagcatgccctactggctaaggcaatcttcaagctaacctaccaaaataaagtggtaagggtacagagaccagcaaaaaatggaactgtgatggatgtcatatccagacgtgaccagagaggaagtggccaggtcggaacttatggcttaaacactttcaccaacatggaagcccagctgataagacaaatggagtctgagggaatcttctcacccagtgaattagagaccccaaatttagccgagagagttctctactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagacataccgcaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgtaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6285 - RNA, 9879 nt, synthetic construct
  misc_feature 1..9879: note = derived and/or modified CDS sequence (wt) from DENV-1__KM403627__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaattttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggatcagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcgcgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgattccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatatacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgactttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcactttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagagtcctttccacagagcaatgcagttatccaagatgaggaaagagacattcctgagagatcatggaactcaggttacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6286 - RNA, 9879 nt, synthetic construct
  misc_feature 1..9879: note = derived and/or modified CDS sequence (wt) from DENV-1__KM403584__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttctagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaagtacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagtcactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatataaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgcctatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctcccgaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgacagggtaatagacccaaggcggtgcttgaagccggtaatactaaaagatggcccagagcgcgtcattctagctggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcagcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggggcaggtctggccttctcattaatgaaatctttaggaggaggtaggagaggcacgggagctcaaggggaaacattgggagaaaaatggaaaagacaactaaaccaactgagcaagtcagaatttaacacttacaaaaggagtggaattatggaggtggacagatctgaagccaaggagggaatgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatttgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaaactgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgatcccgaaggagccctctggtaa

SEQ ID NO: 6287 - RNA, 9879 nt, synthetic construct
  misc_feature 1..9879: note = derived and/or modified CDS sequence (wt) from DENV-1__KM403633__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgagagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6288 - RNA, 9879 nt, synthetic construct
  misc_feature 1..9879: note = derived and/or modified CDS sequence (wt) from DENV-1__KM403592__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtggcccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctggtcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaatgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctgggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6289 - RNA, 9879 nt, synthetic construct
  misc_feature 1..9879: note = derived and/or modified CDS sequence (wt) from DENV-1__KM403593__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtggcccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtagccataaaccaagtgagaaggcttattgggaacgagaattatttagactacatgacatcaatgaagagattcaagaatgagagtgatcccgaaggagccctctggtaa

SEQ ID NO: 6290 - RNA, 9879 nt, synthetic construct
  misc_feature 1..9879: note = derived and/or modified CDS sequence (wt) from DENV-1__KM403603__SS-prME
  source 1..9879: mol_type = other RNA
tccgtgaccatgctcctcatgctgctgcccacagccctggcgttccatttgactacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttgccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaagttcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttgaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctgctttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtggacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaaactttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6291 - RNA, 9879 nt, synthetic construct
  misc_feature 1..9879: note = derived and/or modified CDS sequence (wt) from DENV-1__KM403585__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttctagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaggatagttcaatatgaaaacttaaaatattcggtgatagtcactgtccacactggggaccagcaccaggtaggaaatgagactacagaacatggaacaattgcaaccataacacctcaagctcccacgtcggaagtacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagtcactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatataaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgcctatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaatatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacattctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctcctgaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgacagggtaatagacccaaggcggtgcttgaagccggtaatactaaaagatggcccagagcgcgtcattctagctggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaaggaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcagcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggggcaggtctggccttctcattaatgaaatctttaggaggaggtaggagaggcacgggagctcaaggggaaacattgggagaaaaatggaaaagacaactaaaccaactgagcaagtcagaatttaacacttacaaaaggagtggaattgtggaggtggacagatctgaagccaaggagggaatgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatttgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggtttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaaactgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgatcccgaaggagccctctggtaa

SEQ ID NO: 6292 - RNA, 9879 nt, synthetic construct
  misc_feature 1..9879: note = derived and/or modified CDS sequence (wt) from DENV-1__KM403595__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaatagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagacagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6293 - RNA, 9879 nt, synthetic construct
  misc_feature 1..9879: note = derived and/or modified CDS sequence (wt) from DENV-1__KM403604__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacaaggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcaatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggcccccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaaggaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgctaatgttagtggctcattatgccataatcggacctggactgcaagcaaaagctaccagagaagcccaaaaaaggactgcggccggaataatgaaaaatccaactgtggacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttatggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaatagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6294 - RNA, 9879 nt, synthetic construct
  misc_feature 1..9879: note = derived and/or modified CDS sequence (wt) from DENV-1__KM403588__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatgggtaaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacatagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcagggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgttgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtattccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtggccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgaggggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacctatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6295 - RNA, 9879 nt, synthetic construct
  misc_feature 1..9879: note = derived and/or modified CDS sequence (wt) from DENV-1__KM403605__SS-prME
  source 1..9879: mol_type = other RNA
tccgtgaccatgctcctcatgctgctgcctacagccctggcgttccatttgactacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaatccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttgaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctgctttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtggacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaaactttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgaggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6296 - RNA, 9879 nt, synthetic construct
  misc_feature 1..9879: note = derived and/or modified CDS sequence (wt) from DENV-1__KM403606__SS-prME
  source 1..9879: mol_type = other RNA
tccgtgaccatgctcctcatgctgctgcccacagccctggcgttccatttgactacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgttggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagacacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttgaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctgctttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtggacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaaactttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6297 - RNA, 9879 nt, synthetic construct
  misc_feature 1..9879: note = derived and/or modified CDS sequence (wt) from DENV-1__KM403591__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaagatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatgggtaaactgactctaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggatcctgctgacatggctaggattgaattcaaggagcacgtcactctcgatgacgtgcattgcagttggcatggtcacactgtacctaggagttatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagttacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttctcataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcatcttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtattccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaaaaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccaaaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacctatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaaaccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagatctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6298 - RNA, 9879 nt, synthetic construct
  misc_feature 1..9879: note = derived and/or modified CDS sequence (wt) from DENV-1__KM403607__SS-prME
  source 1..9879: mol_type = other RNA
tccgtgaccatgctcctcatgctgctgcctacagccctggcgttccatttgactacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaatccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttgaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctgctttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtggacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaaactttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6299 - RNA, 9879 nt, synthetic construct
  misc_feature 1..9879: note = derived and/or modified CDS sequence (wt) from DENV-1__KM403581__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaactgtgtgaccaccggctaatgtcagctgccatcaaggacagcaaggcagtccatgctgatatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggattaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcagggaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaacaccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6300 - RNA, 9879 nt, synthetic construct
  misc_feature 1..9879: note = derived and/or modified CDS sequence (wt) from DENV-1__KM403597__SS-prME
  source 1..9879: mol_type = other RNA
tccgtgaccatgctcctcatgctgctgcccacagccctggcattccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagccaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatgggaatgggaacaacgtacctagctttaatggccacttttaaaatgagaccgatgttcgctgttgggctattatttcgcagactaacatccagagaggtgctccttctcacaattggattaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcagggaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatatgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6301 - RNA, 9879 nt, synthetic construct
  misc_feature 1..9879: note = derived and/or modified CDS sequence (wt) from DENV-1__KM403610__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactatccacactggggaccagcaccaggtaggaaatgagactacagaacatggaacaattgcaaccataacacctcaagctcccacgtcggaaatacagctgactgactacggagcccttacactggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacaacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagtggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaagtgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtaaaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttagctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatctttttacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcttgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6302 - RNA, 9879 nt, synthetic construct
  misc_feature 1..9879: note = derived and/or modified CDS sequence (wt) from DENV-1__KM403596__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagccctttcattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaatagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgatcaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagacagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6303 - RNA, 9879 nt, synthetic construct
  misc_feature 1..9879: note = derived and/or modified CDS sequence (wt) from DENV-1__KM403616__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtggtagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgctttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagatttaagaatgagagtgatcccgaaggagccctctggtaa

SEQ ID NO: 6304 - RNA, 9879 nt, synthetic construct
  misc_feature 1..9879: note = derived and/or modified CDS sequence (wt) from DENV-1__KM403617__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtggtagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagatttaagaatgagagtgatcccgaaggagccctctggtaa

SEQ ID NO: 6305 - RNA, 9879 nt, synthetic construct
  misc_feature 1..9879: note = derived and/or modified CDS sequence (wt) from DENV-1__KM403635__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcagcatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaagacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtagcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttgttgggaacgagaattatttagactacatgacatcaatgaagagattcaagaatgagagtgatcccgaaggagccctctggtaa

SEQ ID NO: 6306 - RNA, 9879 nt, synthetic construct
  misc_feature 1..9879: note = derived and/or modified CDS sequence (wt) from DENV-1__KM403621__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggatcagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcgcgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgactttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcactttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagagtcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6307 - RNA, 9879 nt, synthetic construct
  misc_feature 1..9879: note = derived and/or modified CDS sequence (wt) from DENV-1__KM403623__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccttttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggatcagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtggtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcgcgaaggatggctatcctgggagacacagcatgggacttcggttccataggaggggtgttcacatctgtgggaaaattggtacaccaggtttttggaaccgcatatggggtcctgttcagcggtgtttcctggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgactttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcactttcaagacccctgaaggcgaagttggagccatagccctggatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagagtcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaagaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6308 - RNA, 9879 nt, synthetic construct
  misc_feature 1..9879: note = derived and/or modified CDS sequence (wt) from DENV-1__KM403575__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6309 - RNA, 9879 nt, synthetic construct
  misc_feature 1..9879: note = derived and/or modified CDS sequence (wt) from DENV-1__KM403586__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccttttttctagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaagtacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagtcactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccactgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgcctatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagagagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatatccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctcctgaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagagggaaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaactgacatttccgaaatgggagcaaatttccgggccgacagggtaatagacccaaggcggtgcttgaagccggtaatactaaaagatggcccagagcgcgtcattctagctggaccaatgccagtgaccgcggccagtgctgcccagaggagaggaagaattggaaggaaccaaaacaaggaaggtgaccagtatatttacatgggacagcctttaaacaatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcagcctccatcatactagagttttttctgatggtgctgctcattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaagattctggaataccacgatagcagtgtccatggcaaacatcttcaggggaagttatttagcaggggcaggtctggccttctcattaatgaaatctttaggaggaggtaggagaggcacgggagctcaaggggaaacattgggagaaaaatggaaaagacaactaaaccaactgagcaagtcagaatttaacacttacaaaaggagtggaattatggaggtggacagatctgaagccaaggagggaatgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtgaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatttgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggtttcatgaatgaagaccactggttcagtagggagaattcactcagtggagtggaaggagaaggactacataaacttggatacatacttagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaaactgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaatgagaattatttagactacatgacatcaatgaagagattcaagaatgagagtgatcccgaaggagccctctggtaa

SEQ ID NO: 6310 - RNA, 9879 nt, synthetic construct
  misc_feature 1..9879: note = derived and/or modified CDS sequence (wt) from DENV-1__KM403602__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtattggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagccattacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaagtgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtaaaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgataatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6311 - RNA, 9879 nt, synthetic construct
  misc_feature 1..9879: note = derived and/or modified CDS sequence (wt) from DENV-1__KM403582__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcaaccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatggtaatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggcatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcccgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagacagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatctttaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6312 - RNA, 9879 nt, synthetic construct
  misc_feature 1..9879: note = derived and/or modified CDS sequence (wt) from DENV-1__KM403577__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccttttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaacactaccttcatcatcgatggcccagacactccagaatgccccgatgaccagagagcatggaacatttgggaagttgaggactatgggtttggagttttcacgacaaatatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaagagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcagggaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaatgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaacaatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggttatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6313 - RNA, 9879 nt, synthetic construct
  misc_feature 1..9879: note = derived and/or modified CDS sequence (wt) from DENV-1__KM403631__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccaatcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6314 - RNA, 9879 nt, synthetic construct
  misc_feature 1..9879: note = derived and/or modified CDS sequence (wt) from DENV-1__KM403632__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacactggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaggtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacacttcaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgtttgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatccgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6315 - RNA, 9879 nt, synthetic construct
  misc_feature 1..9879: note = derived and/or modified CDS sequence (wt) from DENV-1__KM403583__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggatagacgttctgtcgcattggccccacacgtggggcttggtctcgaaacaagaaccgaaacgtggatgtcctctgaaggcgcctggaggcagatacaaagagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctattttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6316 - RNA, 9879 nt, synthetic construct
  misc_feature 1..9879: note = derived and/or modified CDS sequence (wt) from DENV-1__KM403579__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatatacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggctagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaattgggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattgggaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaagcttattgggaacgagaattatttagactacatgacatcaatgaagagattcaagaatgagagtgatcccgaaggagccctctggtaa

SEQ ID NO: 6317 - RNA, 9879 nt, synthetic construct
  misc_feature 1..9879: note = derived and/or modified CDS sequence (wt) from DENV-1__HM469968__SS-prME
  source 1..9879: mol_type = other RNA
tctgtgaccatgctcctcatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacaatgacttacaaatgccctcgaatcactgaggcggaaccagatgacgttgattgttggtgcaatgctacagacacatgggtgacctatggaacatgttcccaaactggcgagcaccgacgagacaaacgttccgtcgcactagccccacacgtgggacttggtttggaaacaagaaccgaaacgtggatgtcctccgaaggcgcttggaaacagatacaaagagtggagacttgggccctgagacacccaggattcacggtgatagccctctttctagcacatgccataggaacatccatcacccagaaagggatcatcttcattttgctaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcaccaggtggggaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaagtcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactgagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggcgtttcctggaccatgaaaataggaataggggctctgctgacatggctgggattaaactcaaggagcacgtcactttcgatgacgtgcattgcagttggcctagtaacgctatacttaggagtcatggttcaggcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaagcatgggaggagggtgtgtgtggaattcgatcagcaactcgtctcgagaacatcatgtggaagcaaatatcaaatgaattgaaccacatcttacttgaaaatgacatgaaattcacagtggttgtaggagatgttgctgggatcttggctcaagggaaaaaaatgattaggccacaacccatggaatacaaatactcgtggaaaagctggggaaaggctaaaatcataggggcagatgtacagaacaccaccttcatcatcgacggcccaaacaccccagaatgccctgatgatcaaagagcgtggaacatttgggaagttgaggattatggatttggaattttcacgacaaacatatggctgaaattgcgtgactcctacacccaagtgtgtgaccatcggctaatgtcagctgccatcaaggacagcaaggcagttcacgctgacatggggtactggatagaaagtgaaaagaacgagacctggaagctggcaagagcctctttcatagaagtcaaaacatgtatctggccaaaatcccacactctatggagcaatggagttctggaaagtgaaatgataattccaaagatctatggaggaccaatatctcagcacaactacagaccaggatatttcacacaaacggcaggaccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggcatggaaatcagaccagtcaaggaaaaggaagagaatctagtcaaatcaatggtttctgcagggtcaggggaagtggacagcttttcactaggactgctatgcatatcaataatgatcgaagaggtgatgagatccagatggagtagaaaaatgctgatgactggaacactggctgtgttcttccttctcataatgggacaactgacatggaatgatctgatcagattatgcatcatggtcggagccaatgcttccgacaggatggggatgggaacgacgtacctagctctgatggccacttttaaaatgagaccaatgtttgctgtagggctactattccgcagactaacatccagagaagttctccttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaagccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccacttttaccatgcgtctcctgtctcccgtgagagttcccaattacaacatgattatcatggatgaagcacatttcaccgatccatctagcatagcggctagagggtacatctcaacccgagtgggcatgggtgaagcagctgcgatcttcatgacagccactcccccaggatcagtggaggcctttccacagagtaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctctttgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattagaaatagggaaacttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacgctgttcttcctatcaggaaggggcctagggaaaacatctatcggcctactctgcgtgatggcttcaagcgtactgctatggatggccagtgtagagccccattggatagcggcctccatcatactggagttcttcctgatggtgctgcttattccagaaccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacctacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcaaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaagcaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcggtttccatggcaaacattttcagaggaagttacctagcaggagcaggtctggccttctcactaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaacctcgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagttgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggtaaccaattctgcataaaaattctgaatccctacatgccaagtgtggtggaaactctggagcaaatgcaaagaaaatatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggattgagaacataaaacatgaacacaagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccttttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagtttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatgggaccgtgatggatgtcatatccagacgtgaccagagaggaagtggccaggtcggaacttatggcttaaacactttcaccaacatggaagcccagctgataagacaaatggagtctgagggaatctttttacccagtgaattagagaccccaaatttagctgagagagttctcgactggctggaaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaaatcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6318 - RNA, 9879 nt, synthetic construct
  misc_feature 1..9879: note = derived and/or modified CDS sequence (wt) from DENV-1__KC172834__SS-prME
  source 1..9879: mol_type = other RNA
tctgtgaccatgctccttatgctgatgcccacagccttggcgttccatttgacaacacgagggggagagccgcacatgatagtcagcaagcaggaaagaggaaagtcacttttgtttaagacctcagcaggtgtcaacatgtgcaccctcatagcgatggatttgggagagttatgtgaggacacaatgacttacaaatgccctcgaatcactgaggcggaaccagatgacgttgattgttggtgcaatgccacagacacatgggtgacctatggaacatgttcccaagctggcgagcaccgacgagacaaacgttccgtcgcactggccccacacgtgggacttggtttggaaacaagaactgaaacgtggatgtcctctgaaggcgcttggaaacagatacaaagagtggagacttgggccctgaggcacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacactaccaccgactcaagatgtccaacacaaggagaagccacactggtggaagaacaagacgcgaactttgtgtgtcgacgaacgtttgtggacagagggtggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctctcacattggattgttcacctagaacaggactagactttaatgaaatggtgttgttgacaatgaaagaaaaatcatggctagtccacaaacaatggtttctagacttaccactgccttggacctcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacatttgaaatgtagactaaagatggacaaactgactctaaaagggatgtcatatgtgatgtgcacaggctcattcaagctagagaaagaagtggctgagacccagcatggaaccgttctagtgcagattaaatatgaaggaacagatgcaccatgtaagatccctttttcgacccaagatgaaaaaggagtaacccagaacgggagattgataacagccaaccccatagtcactgacaaagaaaaaccagtcaacattgaggcagaaccgccttttggtgagagttacatcgtgataggagcaggtgaaaaagctttgaaattaagctggttcaagaaaggaagcagcatagggaaaatgtttgaggcaactgccagaggagcacgaaggatggccatactgggagacaccgcatgggactttggttctataggaggagtgttcacgtctgttggaaaattagtgcaccagatttttggaactgcatatggagttttgttcagcggtgtttcctggaccatgaaaataggaataggggttctgctgacatggctaggattaaactcaaggagtacgtccctctcgatgacgtgtattgcagttggcctagtaacactatacctaggagtcatggttcaggcggattcaggatgcgtaattaattggaaaggtagagaactcaaatgtggaagtggcatttttgtcaccaatgaagttcacacttggacagagcaatataaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaactccaccttcatcattgacggcccaaacaccccagaatgccctgatgatcaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagtgcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatcccagcataactacagaccaggatacttcacacaaacggcagggccgtggcacctaggcaagttggaactggactttgatttgtgtgagggcaccacagtcgttgtggatgaacattgtggaaatcgaggaccatctcttaggaccacaacagttacaggaaagataattcatgaatggtgttgcagatcttgtacgctaccacccttacgtttcagaggagaagatgggtgctggtacggcatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagactatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggactgagtctagtggcatctgtggagttaccaaattccttggaggagctgggggatggacttgcaatgggcatcatgattttaaaattattgactgactttcaatcacatcagttatgggctaccttgctgtccttgacatttatcaaaacaacgttttccttgcactatgcatggaagacaatggctatggtactgtcaattgtatctctcttccccttatgcctgtccacgacctctcagaaaacaacatggcttccggtgctattgggatctcttggatgcaaaccactaaccatgtttcttatagcagaaaacaaaatctggggaaggaaaagttggcccctcaatgaagggatcatggctgttggaatagtcagcatcctactaagttcactcctaaaaaatgatgtgccgctagctgggccactaatagctggaggcatgctaatagcatgttatgtcatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaactattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtgggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggtttcaaggatcctggaacacgggagaagaagtgcaggtgattgctgttgaaccagggaaaaaccccaaaaatgtacaaacagcgccgggcacctttaagacccctgaaggtgaagttggagccattgccttagattttaaacccggcacatctggatctcccatcgtgaacagagaaggaaaaatagtaggtctttatggaaatggagtagtaacaacaagtggaacctacgtcagtgccatagctcaagccaaagcatcacaagaagggcccctaccagagattgaagacgaagtgtttaggaaaagaaacttaacaataatggacctacatccaggatcgggaaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaatatgattatcatggatgaagcacatttcaccgatccatccagcatagcggccagagggtacatctcaacccgagtgggtatgggtgaagcagctgcgatcttcatgacagccactcccccaggatcaatggaggcctttccacagagcaacgcagtcatccaagatgaggaaagagacattcctgagagatcatggaacttaggacatgagtggatcactgacttcccaggtaaaacagtctggtttgttccaagcattaaagcagggaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaggatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaagaaacaaccaggtgttggaggagaacatggacgtggagatctggacaaaagaaggagaaagaaagaaactgcgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatattgcacaactccgaacaaggaggaagagcctatagacatgcaatggaagaactgccagacaccatagaaacgttgatgctcctagctctgatagctgtgttaactggtggagtgacgctgttcttcctatcaggaaagggcctagggaaaacatctatcggcctactctgcgtgatggcttcaagtgtactgctatggatggccagtgtggagccccattggatagcggcctccatcatactagagttcttcctgatggtattgcttattccagagccagacagacaacgcactccgcaggacaaccagctggcatatgtggtgataggtttgttatttatgatactgacagtagcagccaatgagatgggactgttggaaaccacaaagaaagacttagggattggccatgtggctgttgaaaatcaccaccatgccgcaatgctggacgtagacttacatccagcttcagcctggaccctttatgcagtggccacaacaattatcactcccatgatgaggcacacaatcgaaaacacaacggcaaacatctccctgacagccattgcaaaccaggcagctatattgatgggacttgataaaggatggccaatatcgaagatggacataggagttccacttctcgccttggggtgctattcccaggtgaatccactgacgctgacagcggcggtgttgatgctagtggctcattacgccataattgggcctggactgcaagcaaaagccactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggctgtggaagaggtggctggtcatactattgcgctgggctgaagaaagtcacagaagtgaagggatatacgaaaggaggacctggacatgaggaaccaatcccaatggcgacctatggatggaacctagtaaaactgcactccgggaaagacgtattctttgtaccacccgagaaatgtgatacccttttgtgtgacattggtgagtcctctccaaacccaaccatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatacgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctctctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaagaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaattagcggagatgactgcgtagtgaaaccaattgacgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggggcctgagagaaactgcatgcctaggcaagtcatatgcacaaatgtggcagctgatgtacttccacaggagagacctgagactagccgctaatgctatctgttcagccgttccagttgattgggtcccaaccagccgcaccacttggtcgatccatgcccatcaccaatggatgacaacagaagacatgctgtcagtgtggaatagggtttggatagaggaaaacccatggatggaggacaaaacccgtatatccagttgggaagatgtcccatatctagggaaaagggaagatcaatggtgtggatctctaataggcttaacagcaagggccacctgggccaccaacatacaagtggccataaaccaagtgagaagactaattgggaatgagaactattcagattacatgacatcaatgaagagattcaagaacgagagtgaacccgaaggggcactctggtga

SEQ ID NO: 6319 - RNA, 9879 nt, synthetic construct
  misc_feature 1..9879: note = derived and/or modified CDS sequence (wt) from DENV-1__KJ933413__SS-prME
  source 1..9879: mol_type = other RNA
tctgtgaccatgctcctcatgctgctgcccacagccctagcgtttcatctgaccactcggggaggagagccgcacatgatagttagcaagcaggaaagaggaaaatcacttttgtttaagacctctacaggtgtcaacatgtgtacccttattgcaatggatttgggagagttatgtgaggacacaatgacctacaaatgccccaggatcactgagacggagccagatgacgttgactgttggtgcaatgccacggagacatgggtgacctatggaacatgttctcaaactggtgaacaccgacgagacaaacgttccgtcgcattggcaccacacgtagggcttggcctagaaacaagaaccgaaacgtggatgtcctctgaaggtgcttggagacaaatacaaaaagtggagacttgggctctgagacacccaggattcacggtgatagccctttttctagcacatgctataggaacatccatcacccagaaagggattatttttattttgttgatgctggtaactccatccatggccatgcggtgcgtagggataggcaacagagacttcgtggaaggactgtcgggagctacgtgggtggatgtagtgctggagcatggaagttgcgtcactaccatggcaaaagacaaaccaacactggacattgaactcctgaagacggaggtcacaaaccctgcagtcctgcgcaaactgtgcattgaagctaaaatatcaaataccaccaccgattcgagatgtccaacacaaggagaagccacgctggtggaagagcaggacacgaactttgtgtgccgacgaacgctcgtggacagaggctggggcaatggttgtgggctatttggaaaaggtagcttaataacgtgtgctaagtttaagtgtgtgacaaaactggaaggaaagatagtccaatatgaaaacttaaaatattcagtcatagtcaccgtacacactggagaccaacaccaagttggaaatgagaccacagaacatggaacaactgcaaccataacacctcaagctcccacgtcggaaatacagctgacagactacggagctctaacactggattgttcacctagaacaggactagactttaatgagatggtgttgttgacgatgaaagaaaaatcatggctcgtccacaaacaatggtttctggacctaccactgccttggacctcaggggcctcaacatcccaagagacttggaatagacaagacctgctggtcacattcaagacagctcatgcaaaaaagcaagaagtagtcgtgctaggatcacaagaaggagcaatgcatactgcgctgactggagcgacagaaatccaaacgtctggaacgacaacaatttttgcagggcacctgaaatgcagactaaaaatggataaactgaccttaaaaggggtatcatatgtaatgtgcacagggtcattcaagctagagaaggaagtggctgagacccagcatggaactgttctagtgcaagttaaatacgaaggaacagatgcaccatgcaagatccccttcacgtcccaagatgagaagggagtaacccagaatgggagattgataacagccaaccccatagtcactgacaaagaaaaaccagtcaacattgaagcggagccaccttttggggagagctaccttgtggtaggagcaggtgaaaaagctttgaaactaagctggttcaagaagggaagcagtatagggaaaatgtttgaagcaactgcccgcggagcacgaaggatggccatcctgggagacaccgcatgggacttcggttctataggaggggtgttcacatctgtgggaaaactgatacaccagatttttgggactgcgtatggagtcttgttcagcggggtttcttggaccatgaaaataggaatagggattctgctgacatggctaggattaaattcaaggagcacatccctttcaatgacgtgtatcgcagtcggcatggtcacactgtacctaggagtcatggttcaggcggactcgggatgtgtaatcaactggaaaggcagagaactcaaatgtggaagcggcatttttgtcaccaatgaagtccacacctggacagagcaatacaaattccaggccgactcccccaagagactatcagcggccattgggaaggcatgggaggagggtgtgtgtgggatccgatcagtcactcgtctcgagaacattatgtggaagcaaatatcaaatgaattaaaccacatcttacttgagaatgacatgaaatttacagtggtcgtaggagacgttaatggaatcttggcccaaggaaagaaaatgattaggccgcaacccatggaacacaaatactcgtggaaaagctggggaaaagccaaagtcataggagcagatgtacagaatagcaccttcatcatcgacggcccaaacaccccagaatgccctgatgatcaaagagcatggaatatttgggaagtcgaagactatggatttggaattttcacgacaaacatatggttgaaattgcgtgactcctacactcaagtgtgtgaccaccggctaatgtcagctgccatcaaggatagcaaagcagtccatgctgacatggggtactggatagaaagtgaaaagaacgagacttggaagttgacaagagcctccttcatagaagttaagacatgcgtctggccaaaatcccacaccctatggagcaatggagtcttggaaagtgagatgataatcccaaagatatatggaggaccaatatctcagcacaactacagaccaggatatttcacacaaacagcaggaccgtggcacttgggcaagctagaactggattttggtttatgtgaaggtaccactgttgttgtggatgaacattgtggaaaccgaggaccatctcttagaaccacaacagtcacaggaaagataatccatgaatggtgctgtagatcttgcacgttaccccccttacgattcaaaggagaagacgggtgctggtacggcatggaaatcagaccagtcaaggagaaggaagagaacctagtcaagtcaatggtctctgcagggtcaggagaagtggacagtttttcactaggactgctatgcatatcaataatgatcgaagaggtaatgagatccagatggagcagaaaaatgctgatgactggaacactggctgtgttcctccttcttataatgggacagttgacatggaatgatctgatcagactgtgcatcatggttggagccaatgcctcagacaagatggggatgggaacgacgtacctagctttgatggccactttcagaatgagaccaatgttcgcagtcgggctactgtttcgcagattaacatctagagaagttctccttctcacagttggattgagtctagtggcatctgtagaactaccaaattccttggaggagctaggggatggacttgcaatgggcattatgatgttgaaattactgactgattttcagtcacatcagctatgggctgccttgctgtctttaacatttgtcaaaacaactttttcattgcactatgcatggaagacaatggctatgatactgtcaattgtatctctcttccctttatgcctgtccacgacttctcaaaaaacaacatggcttccggtgttgctgggatctcttggatgcaaaccactaaccatgtttcttattacagaaaacagaatctggggaagaaaaagctggcctctcaatgagggaattatggctgttggaatagttagcattcttctaagttcacttcttaaaaatgatgtaccactagctggcccactaatagctggaggcatgctgatagcatgttatgtcatatctggaagctcggccgatttatcactggagaaagcggctgaggtctcctgggaagaagaagcagaacactctggtgcctcacacaacatactagtggaggtccaagatgatggaaccatgaagataaaagatgaagagagagatgacacacttaccattctcctcaaagcaactctgctagcaatctcaggggtatacccaatgtcaataccggcgaccctctttgtgtggtatttttggcagaaaaagaaacagagatcaggagtgctatgggacacacccagccctccagaagtggaaagagcagtccttgatgatggtatttatagaattctccaaagaggactgttgggcaagtctcaagtaggggtaggagtctttcaagaaggtgtgttccacacaatgtggcacgtcaccaggggagctgtcctcatgtaccaagggaagagattggaaccaagttgggccagtgtcaaaaaagacttgatctcatatggaggaggttggaggtttcaaggatcctggaacacgggagaagaagtgcaggtgattgctgttgaaccgggaaagaacccaaaaaatgtacagacagccccgggtacctttaaaacccctgaaggcgaagttggagccatagctctagacttcaaacccggcacatctggatctcctattgtgaacagagagggaaaaatagtaggtctttatggaaatggagtggtgacaacaagtggaacctacgtcagtgccatagctcaagccaaagcatcacaagaagggcctctaccagagattgaggacgaggtgtttaggaaaagaaacctgacaataatggacctacatccaggatcgggaaaaacaagaagataccttccagccatagtccgtgaggctataaaaagaaaactacgcacgctagtcttggctcccacaagagttgtcgcctctgaaatggcagaggcactcaagggaatgccaataaggtaccagacaacagcagtgaaaagtgaacacacgggaaaggagatagttgaccttatgtgtcacgccacttttaccatgcgtctcctctcccctgtgagagttcccaattataatatgattatcatggatgaagcacatttcactgatccagccagcatagcagccagagggtatatctcaacccgagtgggtatgggtgaagcagctgcaattttcatgacggccactccccccggatcgatggaggcctttccacagagcaatgcagctatccaagatgaggaaagagatattcctgaaaggtcttggaactcaggctatgactggattactgatttcccaggaaaaacagtttggtttgttccaagcatcaaatcaggaaatgacattgccaactgtttaagaaagaatgggaaacgggtggtccaattaagcagaaaaacctttgacactgagtaccagaagacaaaaaacaacgactgggactatgttgtcacaacagacatatccgaaatgggagcaaacttccgagctgacagggtaatagacccaaggcggtgcctaaaaccggtaatactaaaagatggcccagagcgtgtcattctagccggaccaatgccagtgactgtggctagcgccgcccagaggagaggaagaattggaaggaaccaaaataaggaaggtgatcagtatatttacatgggacagcctctgaacaatgatgaggaccatgcccattggacagaagcaaaaatgctccttgacaacataaacacaccagaagggattatcccagccctctttgagccggagagagaaaagagcgcagcaatagacggggaatacagactacggggtgaagcgaggaaaaccttcgtggagcttatgagaagaggagatctacctgtctggctatcctacaaagttgcctcagaaggcttccagtactctgacagaaggtggtgctttgatggagaaaggaacaaccaggtgctggaggagaacatggatgtggagatctggacaaaagaaggagaaagaaagaaactacgaccccgctggctggacgccagaacatactctgacccactggctctgcgcgaattcaaagagttcgcagcaggaagaagaagcgtctcaggtgacctaatattagaaatagggaaacttccacaacatctaacgcaaagggcccagaatgccttggacaacctggttatgctgcacaactctgaacaaggaggaaaagcctatagacacgccatggaagaactaccagacactatagaaacgttaatgcttctggctttgatagctgtgttgactggtggggtgacgttgttcttcctatcaggaaggggtctaggaaaaacatccattggtctactctgcgtgatggcctcaagtgcactgttatggatggccagtgtggaaccccattggatagcggcctctatcatactggagttctttctgatggtgttgcttattccagaaccggacagacagcgcactccacaagacaaccagctagcatacgtggtgataggtctattattcatgatattgacagtggcagccaatgagatgggattactggaaaccacaaagaaggacctagggattggtcatgtggctgctgaaagccatcatcatgctgcaatgctggacgtagacctacatccagcttcagcctggaccctttatgcagtggccacaacagttatcactcccatgatgagacacacaattgaaaacacaacggcaaacatctccctgacagctattgcaaaccaggcagctatattgatgggacttgacaagggatggccaatatcaaagatggacataggagttccccttcttgccttggggtgctattctcaggtgaacccgctgacgctgacagcggcggtgttgatgttagtggctcattatgccataattggacccggactgcaagcaaaagctactagagaagctcaaaaaaggacagcagctggaataatgaaaaacccaactgtcgatgggatcgttgcaatagatttggaccctgtggtttacgatgcaaaatttgaaaaacagctaggccaaataatgctgttgatactttgcacatcacagattctcctgatgcggaccacatgggccttgtgtgaatccatcacactagccactggacctctgaccacactctgggagggatctccaggaaaattctggaacaccacgatagcggtgtccatggcaaacatctttaggggaagctatctagcaggagcaggtctggccttctcattaatgaaatctctaggaggaggtaggagaggcacgggagcccaaggggaaacactgggagaaaaatggaaaagacagctgaaccaattgagtaagtcagaattcaacacttacaaaaggagtgggatcatagaggtggatagatctgaagccaaagaggggttaaaaagaggagaaacgactaaacacgcggtgtcgagaggaacggccaaactgaggtggtttgtagagaggaaccttgtgaaaccagaagggaaagtcatagacctcggttgtggaagaggtggctggtcatattattgcgctgggctgaagaaagtcacagaagtgaaaggatacacgaaaggaggacctgggcatgaggaaccaattccaatggcaacctatggatggaacctagtaaaactacactccgggaaagatgtattctttacaccacctgagaaatgtgacaccctcttgtgcgatattggtgagtcctctccgaacccaaccatagaagaaggaagaacgttacgtgtactaaagatggtggaaccatggcttagaggaaaccaattttgcataaaagttctaaatccctatatgccgagcgtggtagaaactttggagcaaatgcaaagaaaacatggaggaatgctagtgcgaaatccactctcaagaaactccactcatgaaatgtactgggtttcatgtggaacaggaaatattgtgtcagcagtaaacatgacatctagaatgctgctgaatcgattcacaatggctcacaggaagccaacatatgaaagagacgtggacttaggcgctggaacaagacatgtggcagtagaaccagaggtggccaacctagatatcattggccagaggatagaaaatataaaaaatgaacacaaatcaacatggcattatgatgaggataatccatacaaaacatgggcctatcatggatcatatgaagtcaagccatcaggatcagcctcatccatggtcaatggtgtggtgagactgctaaccaaaccatgggatgtcatccccatggtcacacaaatagccatgactgacactacaccctttggacaacagagggtgttcaaagagaaagttgacacgcgcacaccaaaagcgaagcgaggcacagcacaaattatggaggtgacagctaggtggttatgggggtttctctctagaaacaaaaaacccagaatctgtacaagagaggagttcacaaaaaaagtcaggtcaaacgcagctattggagcagtgttcgttgatgaaaatcaatggaactcagcaaaagaggcagtggaagatgaacggttctgggaccttgtgcacagagagagggagcttcataagcaaggaaagtgtgccacgtgtgtctacaacatgatgggaaagagagagaaaaaattaggagagtttggaaaggcaaaaggaagtcgcgcaatatggtacatgtggttgggagcgcgctttttagagtttgaagcccttggtttcatgaatgaagatcattggttcagcagagagaattcactcagtggagtggagggagagggactccacaaacttgggtacatactcagagacatatcaaagattccagggggaaatatgtatgcagatgacacagccggatgggacacaagaataacagaggatgatcttcagaatgaggccaaaatcactgacatcatggaacctgaacatgccctactggccacgtcaatcttcaagctaacctaccaaaacaaggtagtaagggtgcagagaccagcaaaaaatggaaccgtgatggatgtcatatccaggcgtgaccagagaggaagtggacaggttggaacctatggcttaaacaccttcaccaacatggaggcccaactaataagacaaatggagtctgagggaatctttttacccagcgaattggaaaccccaaatctagctgaaagagtccttgactggttggaaaaatatggcatcgagaggctgaaaagaatggcaatcagtggagatgactgtgtggtgaaaccaattgatgacagattcgcaacagccttaacagctttgaatgacatgggaaaggtaagaaaagacataccacaatgggaaccctcaaaaggatggaatgattggcaacaagtgcccttctgttcacaccatttccaccagctgattatgaaggacgggagggagatagtggtgccatgccgcaaccaagatgaacttgtgggtagggctagagtatcacaaggcgccggatggagcctgagagaaactgcatgcctaggcaagtcatatgcacaaatgtggcagctgatgtacttccacaggagagacttgagattagcggctaatgctatctgttcagccgtcccagttgattgggtcccaaccagccgcaccacttggtcgatccatgcccaccaccaatggatgacaacagaagacatgttgtcagtgtggaatagggtttggatagaggaaaacccatggatggaagacaaaactcacgtgtccagttgggaagacgttccatacctaggaaaaagggaagatcaatggtgtggatccctaataggcttaacagcacgagccacctgggccaccaacatacaagtggccataaaccaagtgagaaggctcattgggaatgagaactatctagactacatgacatcaatgaagagattcaaaaacgagagtgatcccgaaggggcactctggtga

SEQ ID NO: 6320 - RNA, 9879 nt, synthetic construct
  misc_feature 1..9879: note = derived and/or modified CDS sequence (wt) from DENV-1__KU666942__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagatacatgggtgacctatggaacatgttcccaaacaggcgagcaccgacgagacaaacgttccgtcgcactggccccacacgtgggacttggcttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcatattgttaatgctggttacaccatccatggccatgcgatgcgtgggaataggcagcagggacttcgtggaaggactgtcaggagcaacttgggtagacgtggtgctggaacatggaagttgcgtcactaccatggcaaaagacaaaccaacattggacattgaactcttgaagacggaagtcacaaaccctgccatcctgcgcaaactgtgcattgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagccttataacgtgtgctaagttcaagtgtgtgacaaaactggaaggaaaaatagttcaatatgaaaacttgaaatattcagtaatagtcaccgttcacactggagaccagcaccaggtaggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcatttaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttgggattaaactcaaggagcacgtccctttcgatgacgtgcattgcagttggcctagtaacgctatacttaggagtcatggttcaggcggattcaggatgtgtaatcaattggaaaggtagagaactcaaatgtggaagtggcatttttgtcaccaatgaagttcacacttggacagagcaatacaaatttcaagctgattccccgaagagactatcaacagccattgggaaggcatgggaggagggtgtgtgtggaattcgatcagcaactcgtctcgagaacatcatgtggaagcaaatatcaaatgaattgaaccacatcttgcttgaaaatggcatgaaattcacagtggttgtaggagatgttgctgggatcttggctcaaggaaaaaagatgattaggccacaacccatggaacacaaatactcgtggaaaagctggggaaaggctaaaatcataggggcagatgtgcagaacaccacctttatcatcgacggtccaaacaccccagaatgccctgatgatcaaagagcatggaacatttgggaagttgaggattatggattcggaattttcacgacaaacatatggctgaaattgcgtgactcttacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactatagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctatggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatagccatggtactgtcaattgtatctctcttccccttatgcctgtccacgacctcccaaaaaacaacatggcttccggtgctgttgggatctcttggatgcaaaccactaaccatgtttctcatagcagaaaataaaatctggggaaggaaaagttggcccctcaatgaaggaatcatggctgttggaatagttagcatcctactaagttcactcctcaaaaatgatgtgccgctagctgggccactaatagctggaggtatgctaatagcgtgttatgttatatctggaagctcggccgatctatcactagagaaagcggctgaggtctcctgggaagaagaagcagaacactctggcgcctcacacaacatattagtggaggtccaagatgacggaaccatgaagataaaggatgaagagagagatgacacgctaaccattctccttaaagcaactctgctagcagtttcaggggtgtacccactatcaataccagcgaccctttttgtgtggtacttctggcagaaaaagaaacagagatctggagtgttatgggacacacctagccctccagaggtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacttgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataacataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggtttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgcactgctatggatggccagtgtagagccccattggatagcggcttccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagacttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatacacaaaaggaggacctggacatgaagaaccagtcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggcttagaggaaaccaattttgcataaaaattctgaatccctacatgcccagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgttgcagtggaaccagaggtagccaacctagatatcattggccagaggatagagaacataaaatgtgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcggtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatatatacttagagacatatcaaagatttcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaactgctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatgaaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6321 - RNA, 9879 nt, synthetic construct
  misc_feature 1..9879: note = derived and/or modified CDS sequence (wt) from DENV-1__KU666939__SS-prME
  source 1..9879: mol_type = other RNA
tctgtgaccatgctccttatgctgatgcctacagccttggcattccatttgactacacgagggggagagccgcacatgatagtcagcaagcaggaaagaggaaagtcacttttgtttaagacctcagcaggtgtcaacatgtgcaccctcatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctctgaaggcgcttggaaacagatacaaagagtggagacttgggtcctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgttggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgccaagttcaagtgtgtgacaaaactggaaggaaaaatagttcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgtttacctagaacaggactggacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacggaaatccaaacatctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaggctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtgggagtggcatttttgtcactaatgaagttcacacttggacagagcaatacaaatttcaagctgattccccaaagagactatcagcagccattgggaaggcatgggaggagggtgtgtgtggaattcgatcagcaacccgtctcgagaacatcatgtggaagcaaatatcaaatgaattgaaccacatcttgcttgaaaatgacatgaaattcacagtggttgtaggagatgttgctgggatcttggctcaagggaaaaaaatgattaggccacaacccatggaacacaaatactcgtggaaaagctggggaaaagctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaagacagcaaggcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcatctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacctacctagctctgatggccacttttaaaatgagaccaatgtttgccgtagggctactattccgcagactaacatccagagaagttcttcttctaacaattggattgagtctagtggcatctgtggagttaccaaattccttggaggagctgggggatggacttgcaatgggcattatgatcttaaaattattgactgactttcaatcacatcagctgtgggctaccttgctgtccttgacatttatcaaaacaacgttttccttgcactatgcatggaagacaatggctatggtactgtcaattgtatctctcatccccttatgcctgtccacgacctcccaaaaaacaacatggcttccggtgctgttgggatctcttggatgcaaaccactaaccatgtttcttatagcagaaaacaaaatctggggaaggaaaagttggcccctcaatgaaggaatcatggctgttggaatagtcagcatcctactaagttcactcctcaaaaatgatgtgccgctagctgggccattgatagctggaggcatgctaatagcatgttatgtcatatctggaagctcagccgatctattactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcaatttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtgggggtaggagtgtttcaagaaaacgtgttccacacaatgtggcatgtcaccaggggagctgtactcatgtaccaagggaagagactggaaccgagctgggccagtgtcaaaaaagacctgatctcatatggaggaggttggaggcttcaaggatcctggaacacgggagaagaagtgcaggtgattgctgttgaaccagggaaaaatcccaaaaatgtacaaacagcgccgggcacttttaagacccctgaaggcgaagttggagccattgccctagattttaaacccggcacatctggatctcccatcgtgaacagagaagggaaaatagtaggtctttatggaaatggagtggtgacaacaagtgggacctacgtcagtgccatagctcaagccaaagcatcacaagaagggcccctaccagagattgaagatgaggtgtttaggaaaagaaacttaacaataatggacctgcatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccaccttcaccatgcgcctcctgtctcccgtgagagttcccaattataacatgattattatggatgaagcacatttcaccgatccatccagcatagcggctagagggtacatctcaacccgagtgggcatgggtgaagcagctgcgattttcatgacagccactcccccaggatcagtggaggcctttccacagagcaacgcagttatccaagatgaggaaagagatattcctgagagatcatggaactcaggttatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcatcttagcaggaccgatgccagtgactgtggccagtgccgcccagaggagaggaagaattggaaggaaccacaacaaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcggcaatagacggggaatacagactgcggggtgaagcaaggaaaacgtttgtggagctcatgagaagaggagatctacctgtctggctatcctacaaagttgcctcagaaggcttccaatactctgacagaagatggtgctttgacggggaaaggaacaaccaggtgttggaagagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggataacctggtcatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggcttagggaaaacatctatcggcctactctgcgtgatggcttcaagcgtattgctatggatggccagtgtagagccccattggatagcggcctccatcatactggagttcttcctgatggtgctgctcattccagagccagacagacaacgcactccgcaggacaatcagctggcatatgtggtgataggtttgttattcatgatactaacagtagcagccaatgagatgggactgctggaaaccacaaagaaagacttagggattggccatgtggctgttgaaaatcaccaccatgccacaatgctggacgtagacttacatccagcttcagcctggaccctctatgcagtggccacaacaatcatcactcccatgatgaggcacacaatcgaaaacacaacggcaaacatttccctgacagccattgcaaatcaggcagctatattgatgggacttgacaaaggatggccaatatcgaagatggacataggagttccacttctcgccttggggtgctattcccaggtgaatccactgacgctgacagcggcggtattgatgctagtggcccattacgctataattggacctggactgcaagcaaaagctactagagaagctcaaaaaaggacagcggccggaataatgaaaaatccaactgttgatggaatcgttgcaatagacttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaggtgaagggatacacaaaaggaggacctggacacgaagaaccaatcccaatggcgacctatggatggaacctagtaaagctgtactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcggttcacaatggctcataggaaaccaacatacgaaagagacgtggacctaggcgccggaacaagacatgtggcagtagaaccagaggtagctaacctagatatcattggccagaggatagagaacataaaacatgaacacaagtcaacatggcattatgatgaggacaatccatataaaacatgggcctatcatggatcatatgaggtcaaaccatcaggatcagcctcatccatggtcaatggtgtggtgaaactgctcaccaaaccatgggatgtcatccccatggtcacacaaatagctatgactgacactacaccctttggacaacagagggtatttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccatcggagcagtgttcattgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtacgctgatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggttgggaaaatatggcgtcgaaaggctgaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaactagccgcaccacctggtctatccatgcccatcaccaatggatgacaacagaagacatgctgtcagtgtggaatagagtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgaaaattatctagattacatgacatcaatgaagagattcaagaacgagagtgatcccgaaggggcactctggtga

SEQ ID NO: 6322 - RNA, 9879 nt, synthetic construct
  misc_feature 1..9879: note = derived and/or modified CDS sequence (wt) from DENV-1__KU666940__SS-prME
  source 1..9879: mol_type = other RNA
tctgtgaccatgctccttatgctgacgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggatacaatgacttacaaatgccctcgaatcactgaggcggaaccagatgacgttgattgttggtgcaatgccacagatacatgggtgacctatggaacatgttcccaaacaggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagacgtggtgctggaacatggaagttgcgtcactaccatggcaaaagacaaaccaacattggacattgaactcttgaagacggaagtcacaaaccctgccgtcctgcgcaaactgtgcattgaagccaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagccttataacgtgtgctaagttcaagtgtgtgacaaaactggaaggaaaaatagttcaatatgaaaacttgaaatattcagtaatagtcaccgttcacactggagaccagcaccaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctttcgatgacgtgcattgcagttggcctagtaacgctatacttaggagtcatggttcaggcggattcaggatgtgtaatcaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaagatgattaggccacaacccatggaacacaaatactcgtggaaaagctggggaaaggctaaaatcataggagcagatgtgcagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactatagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggatagcttttcactaggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatagccatggtactgtcaattgtatctctcttccccttatgcctgtccacgacctcccaaaaaacaacatggcttccggtgctgttgggatctcttggatgcaaaccactaaccatgtttctcatagcagaaaataaaatctggggaaggaaaagttggcccctcaatgaaggaatcatggctgttggaatagttagtatcctactaagttcactcctcaaaaatgatgtgccgctagctgggccactaatagctggaggtatgctaatagcgtgttatgttatatctggaagctcggccgatctatcactagagaaagcggctgaggtctcctgggaagaagaagcagaacactctggcgcctcacacaacatattagtggaggtccaagatgacggaaccatgaagataaaggatgaagagagagatgacacgctaaccattctccttaaagcaactctgctagcagtttcaggggtgtacccactatcaataccagcgaccctttttgtgtggtacttctggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatttacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggtttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtgctgctatggatggccagtgtagagccccattggatagcggcttccatcatactggagttcttcctgatggtgctgcttattccagagccagatagacaacgcactccgcaggacaaccagctggcatatgtggtgataggcttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatacacaaaaggaggacctggacatgaagaaccagtcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggcttagaggaaaccaattttgcataaaaattctgaatccctacatgcccagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgttgcagtggaaccagaggtagccaacctagatatcattggccagaggatagagaacataaaatgtgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatacatacttagagacatatcaaagatctcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaactgctctgaatgatatgggaaaagtaagaaaagatataccacaatgggaaccctcaaaaggatggaatgactggcaacaagtgcctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatgaaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6323 - RNA, 9879 nt, synthetic construct
  misc_feature 1..9879: note = derived and/or modified CDS sequence (wt) from DENV-1__KU666941__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgttaacatgtgcacccttatagcgatggatttgggagagttatgtgaggacacaatgacttacaaatgccctcgaatcactgaggcggaaccagatgacgttgattgttggtgcaatgccacagatacatgggtgacctatggaacatgttcccaaacaggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggattgtcaggagcaacttgggtagacgtggtgctggaacatggaagctgcgtcactaccatggcaaaagacaaaccaacattggacattgaactcttgaagacggaagtcacaaaccctgccgtcctgcgcaaactgtgcattggagccaaaatatcaaacaccaccaccgactcaagatgtccaacacaaggagaagccacactggtggaagaacaagacgcgaactttgtgtgtcgacgaacgtttgtggacagaggctggggcaatggctgtgggcttttcggaaaaggaagccttataacgtgtgctaagttcaagtgtgtgacaaaactggaaggaaaaatagttcaatatgaaaacttgaaatattcagtaatagtcaccgttcacactggagaccagcaccaggtgggaaatgaaagcacagaacatgggacaactgcaactataacacctcaagctcctacgacagaaatacagctgaccgactacggagctcttacattggattgttcacctagaacaggactagacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcgaagaagcaggaagtagtcgtactaggatcacaagaaggagcaatgcacactgcgttgaccggagcgacggaaatccaaacgtctggaacgacaacaatttttgcaggacacttgaaatgtagactaaagatggataaactgactctaaaagggatgtcatatgtgatgtgcacaggctcattcaagctagagaaagaagtggctgagacccagcatggaaccgttctagtgcagattaaatatgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacattgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctttcgatgacgtgcattgcagttggcctagtaacgctatacttaggagtcatggttcaggcggattcaggatgtgtaatcaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcttggctcaaggaaaaaagatgattaggccacaacccatggaacacaaatactcgtggaaaagctggggaaaggctaaaatcataggggcagatgtgcagaacaccacctttatcatcgacggcccaaacaccccagaatgccctgatgatcaaagagcatggaacatttgggaagttgaggattatggattcggaattttcacgacaaacatatggctgaaattgcgtgactcctacacccaagtgtgtgaccaccggctaatgtcagctgctatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactatagaccaggatatttcacacaaacggcagggccgtggcacctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgttacagaggagaagatgggtgttggtacggaatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtaggaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacgatagccatggtactatcaattgtatctctcttccccttatgcctgtccacgacctcccaaaaaacaacatggcttccggtgctgttgggatctcttggatgcaaaccactaaccatgtttctcatagcagaaaataaaatctggggaaggaaaagttggcccctcaatgaaggaatcatggctgttggaatagttagcatcctactaagttcactcctcaaaaatgatgtgccgctagctgggccactaatagctggaggtatgctaatagcgtgttatgttatatctggaagctcggccgatctatcactagagaaagcggctgaggtctcctgggaggaagaagcagaacactctggcgcctcacacaacatattagtggaggtccaagatgacggaaccatgaagataaaggatgaagagagagatgacacgctaaccattctccttaaagcaactctgctagcagtttcaggggtgtacccactatcaataccagcgaccctttttgtgtggtacttctggcagaaaaagaaacagagatctggagtgttatgggacacacctagccctccagaagtggaaagagcagttcttgatgatggtatctatagaatcatgcagagaggactgttgggcaggtcccaagtaggggtaggagtttttcaagaaaacgtgttccacacaatgtggcatgtcaccaggggagctgtactcatgtaccaagggaaaagactggaaccgagctgggctagtgtcaaaaaagacctgatctcatatggaggaggttggaggcttcaaggatcctggaacacgggagaagaagtgcaggtgattgctgttgaaccagggaaaaaccccaaaaatgtacaaacagcgccaggcacctttaagactcctgaaggcgaagttggagccattgccctagattttaaacccggcacatctggatctcccatcgtgaacagagaagggaaaatagtaggtctttatggaaatggagtagtgacaacaagtggaacctatgtcagtgccatagctcaagccaaagcatcacaagaagggcctctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggcaaaacagtttggtttgttccaagcattaaatcaggaaatgatattgccaactgcttaagaaagaatgggaaacgggtgattcaattgagtaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaatcacaataaggaaggtgatcagtacatctacatgggacagcctttaaacaacgatgaagatcacgctcactggacggaagcaaaaatgctccttgataatataaacacaccagaaggaattatcccagccctcttcgagccggagagagaaaagagtgcagcaatagacggggaatacagactgcggggtgaagcaaggaaaacgtttgtggagctcatgagaagaggagatctacctgtctggctatcttacaaagttgcctcagaaggtttccagtactctgatagaagatggtgctttgatggggaaaggaacaaccaggtgttggaggagaacatggacgtggagatctggacaaaagaaggagaaagaaagaaactacgaccccgctggctggatgccagaacatactcagacccactagccctgcgcgagttcaaagagtttgcagcaggaagaagaagtgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcttagggaaaacatctatcggcctactctgcgtgatggcttcaagcgtgctgctatggatggccagtgtagagccccattggatagcggcttccatcatactggagttcttcctgatggtgctgcttattccagagccagatagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttcactgacagccattgcaaaccaggcagctatattgatgggacttgacaaaggatggccaatatcgaagatggacataggagttccacttctcgccttggggtgctattcccaggtgaatccactgacgctaacagcggcggtattgatgctagtggctcattacgctataattggacctggactgcaagcaaaagctactagagaagctcaaaaaaggacagcggccggaataatgaaaaatccaaccgttgatggaatcgttgcaatagatttggaccctgtggtttatgatgcgaaatttgagaaacaactaggccaaataatgttgttgatactatgcacatcacagatcctcttgatgcggactacatgggccttgtgcgaatccatcacactggccactggacctctgaccacgctctgggagggatctccaggaaaattttggaataccacgatagcggtttccatggcaaacattttcagaggaagttatctagcaggagctggtctggccttctcattaatgaaatctctaggaggaggtaggagaggcacgggagcccaaggggaaacactgggagagaaatggaaaagacagctgaaccaactgagtaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagttacagaagtgaagggatacacaaaaggaggacctggacatgaagaaccagtcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggcttagaggaaaccaattttgcataaaaattctgaatccctacatgcccagtgtggtggaaactctggagcaaatgcaaagaaaacatggaggaatgctggtgcgaaatccactctcaagaaattctactcatgaaatgtattgggtttcatgtggaacaggaaacattgtgtcagcaataaacatgacatccagaatgttgctaaatcgattcacaatggctcacaggaaaccaacatatgaaagagacgtggacctaggcgccggaacaagacatgttgcagtggaaccagaggtagccaacctagatatcattggccaaaggatagagaacataaaatgtgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctctctagaaacaagaagccaagaatttgtacaagagaggagttcacaagaaaagttaggtcaaacgcagccattggagcagtgttcgttgacgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagaattcgaagctcttggtttcatgaacgaagatcactggttcagcagagagaattcactcagcggagtggaaggagaaggactccacaaacttggatacatacttagagacatatcaaagatttcagggggaaacatgtatgcagatgacacagccggatgggatacaaggataacagaggatgaccttcagaatgaggccaaaattactgagatcatggaacccgaacatgcccaactggctaaggcaatcttcaagctaacctaccaaaataaagtggtaagggtacagagaccagcaaaaaatggaaccgtgatggatgtcatatccagacgtgaccagagaggaagtggccaagtcggaacttatggcttaaacactttcaccaacatggaagcccagctgataagacaaatggagtctgagggaatcttttcacccagtgaattagagaccccaaatttagccgagagagttctcgactggctggaaaaatatggcgtcgaaaggctaaaaagaatggcaatcagtggagatgactgcgtagtgaaaccaattgatgataggtttgcaacagccctaactgctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtgtcacaaggggctggatggagcctgagagaaaccgcatgcctaggcaaatcatatgcacaaatgtggcagctgatgtacttccacaggagagacctgagactagccgctaatgctatctgttcagccgttccagttgattgggtcccaaccagccgcaccacctggtcgatccacgcccatcaccaatggatgacaacagaagacatgctgtcagtgtggaatagggtttggatagaggaaaacccatggatgaaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6324 - RNA, 9879 nt, synthetic construct
  misc_feature 1..9879: note = derived and/or modified CDS sequence (wt) from DENV-1__KC172835__SS-prME
  source 1..9879: mol_type = other RNA
tctgtgaccatgctccttatgctgatgcccacagccttggcgttccatttgactacacgagggggagagccgcacatgatagtcagcaagcaggaaagaggaaagtcactcttgtttaagacctcagcaggtgtcaacatgtgcacccttatagcgatggatttgggagagttgtgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcttctgaaggcgcttggaaacagatacaaagagtggaaacttgggccctgagacacccaggattcacggtgatagctctttttctagcacatgccataggaacatccatcacccagaaagggatcattttcattttgttaatgctggtaacaccatccatggccatgcgatgtgtgggaataggcagcagggacttcgtggaaggactgtcaggagcaacttgggtagatgtggtactggaacatggaagttgcgtaaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggtaatggctgtgggctcttcggaaaaggaagcctaataacgtgtgctaagttcaagtgtgtgacaaaactggaaggaaagatagttcaatatgaaaacctgaaatattcagtaatagtcaccgtccacactggagaccagcaccaggtgggaaatgaaagcacagaacacgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgttggtgacatttaagacagctcatgcaaagaagcaggaagtagtcgttctaggatcacaagaaggagcaatgcatactgcgttgaccggagcgacagaaatccaaacatctggaacgacaacaatttttgcaggacacttgaaatgtagactaaagatggacaaactgactctaaaagggatgtcatatgtgatgtgcacaggctcattcaagctagagaaagaagtggctgagacccagcatggaactgttctagtgcagattaaatacgaaggaacagatgcaccatgcaagatccctttttccacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggattttggttctataggaggagtgttcacgtctgttggaaaattagtacaccagatttttggaactgcatatggagttttgttcagcggtgtttcctggaccatgaaaataggaataggggttctgctgacatggctaggattaaattcaaggagcacgtccctttcgatgacgtgtattgcagttggcctagtaacactatacctaggagtcatggttcaggcggattcaggatgtgtagttaattggaagggtagagaactcaaatgtggaagtggcatctttgtcaccaatgaagttcacacttggacagagcaatacaaatttcaagctgactccccaaagagattatcagcagccattgggaaggcatgggaggagggtgtgtgtggaattcgatcagcaactcgtctcgagaacgtcatgtggaagcaaatatcaaatgaactgaatcacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaacaccaccttcatcatcgacggtccaaacaccccagaatgccctgatgaccaaagagcatggaacatttgggaagttgaggactatggatttggaattttcacgacaaacatatggctgagattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgcggaaaccgaggaccatctcttaggaccacaacagtcacaggaaagacaattcatgaatggtgttgcagatcttgtacgctaccacccttacgttttagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataataggacaattgacatggaatgatctgatcagattatccatcatggttggagccaacgcttccgacaagatggggatgggaacgacgtacctagctctgatggccacttttaaaatgagaccaatgtttgctgtagggctattattccgcagactaacatccagagaggttcttcttctaacaattggattgagtctagtggcatctgtggagttaccaaattccttggaggagctgggggatggacttgcaatgggcattatgattttaaaattattgactgactttcaaccacatcagctgtgggctaccttgctgtccttgacattcatcaagacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttcttataacagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgatctatcgctagagaaagcggctgaggtctcctgggaagaagaagcagaacactctggtgcctcacataacatattagtggaggtccaagatgatggaaccatgaagataaaggatgaagagagagatgacacgctaaccattctccttaaagcaactctgttagcagtttcaggggtgtacccattatcaatacctgcgaccctttttgtgtggtacttttggcagaaaaagaaacagagatctggagtgttatgggacacacccagccctccagaagtggaaagagcagctcttgatgatggtatctatagaatcatgcagagaggactgttgggcaggtcccaggtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggggtagtgacaacaagtggaacctacgtcagcgccatagctcaagctaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattttggctcccacaagggttgtcgcttccgaaatggcagaggcgctcaagggaatgccaataaggtaccaaacaacagcagtgaagagtgagcacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgtttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgctcagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggatgtggagatctggacaaaagaaggagaaagaaagaaactacgaccccgctggctggatgccagaacatactcagacccactggccctgcgcgagtttaaagagtttgcagcaggaagaagaagcgtttcaggtgatttaatattagaaatagggaaacttccacaacacttgacgcaaagggcccagaatgccttggacaacctggttatgttgcacaactccgaacaaggaggaagagcatatagacatgcaatggaagaactaccagacaccatagaaacgttgatgctcctagctttgatagctgtgttgactggtggagtgacgctgttcttcctatcaggaaggggcctagggaaaacatctatcggcctactctgcgtgatggcttcaagcgtgctgctatggatggccagtgtggagccccattggatagcggcctccatcatactggagttcttcctgatggtgctgcttatcccagagccagacagacaacgcactccgcaggacaaccagctggcatatgtggtgataggtttgttatttatgatactgacagtagcagccaatgagatgggactgctagaaaccacaaagaaagacttagggattggccatgtggctgatgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaatcaagcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcagccggaataatgaagaatccaaccgttgatggaattgttgcaatagatttggaccctgtggtttatgatgcaaaatttgagaaacaactaggccaaataatgttgttgatactatgcacatcacagatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaaggaaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaagattctgaatccctacatgccaagtgtggtggaaactctggagcaaatgcaaagaaaacatggaggaatgctagtgcgaaacccactttcaagaaactctacccatgaaatgtattgggtttcatgtggaacaggaaacattgtgtcagcagtaaacatgacatccagaatgttgctaaatcgattcacgatggttcacaggaaaccaacatatgaaagagacgtggatctaggcgctggaacaagacatgtggcagtggaaccagaggtggccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcattgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagaccactggttcagtagagagaattcacttagcggagtggaaggagaaggactccacaaacttggatatatactcagagacatatcaaagatcccagggggaaacatgtatgcagatgacacagccggatgggatacaaggataacagaggatgatcttcagaatgaggccaaaattactgacatcatggaatccgaacatgccctactggctaagtcaatcttcaagctaacctaccaaaataaagtggtaagggtacagagaccagcaaaaaatggaactgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacagggtgccggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacccatatatccagttgggaagacgttccatacttagggaaaagggaagatcaatggtgtggatccctgataggcttaacagcaagggccacttgggccaccaacatacaagtggccataagccaagtgagaagactaattgggaatgagaattatctagattacatgacatcaatgaagagattcaagaacgagagtgatcccgaaggggcactctggtga

SEQ ID NO: 6325 - RNA, 9879 nt, synthetic construct
  misc_feature 1..9879: note = derived and/or modified CDS sequence (wt) from DENV-1__EU848545__SS-prME
  source 1..9879: mol_type = other RNA
tctgtgaccatgctccttatgctgctgcccacagccctggcgttccatctgaccacacgagggggagagccgcacatgatagttagcaagcaggaaagaggaaagtcacttttgtttaagacctctgcaggtgtcaacatgtgcaccattattgcgatggatttgggagagttatgtgaggacacaatgacctacaaatgcccccggatcactaaggcggaaccagatgacgttgactgttggtgcaatgccacggacacatgggtgacctatggaacgtgttctcgaactggcgaacaccgacgagacaagcgttccgtcgcactggccccacatgtggggcttggtctagaaacaagagccgaaacgtggatgtcctctgaaggcgcttggaaacaaatacaaaaagtggagacttgggctctgagacacccaggattcacggtaatagccctctttctagcacatgccataggaacatccatcacccagaaagggattattttcattttgttgatgctggtaacaccatccatggccatgcgatgcgtgggaataggcaacagagacttcgtggaaggactgtcaggagcaacgtgggtggatgtggtactggagcatggaagttgcgtcaccaccatggcaaaagataaaccaacattggacattgaactcttgaagacggaggtcacaaagcctgccgtcctgcgtaaactgtgcattgaagctaaaatatcaaacaccaccaccgattcaagatgtccaacacaaggggaagccacactggtggaagaacaagacgcgaacttcgtgtgtcgacgaacgtttgtggacagaggctggggcaatggctgtgggcttttcggaaaaggtagcctaataacgtgtgctaagttcaagtgtgtgacaaaactggaaggaaagattgttcaatatgagaacttgaaatattcagtgatagtcaccgtccacactggtgaccagcaccaggtgggaaatgagaccacagaacatggaacaattgcaaccataacacctcaagctcctacgtcggaaatacagctgaccgactacggagctcttacattggattgctcacccagaacagggctagactttaatgagatggtgttgttgacaatgaaagaaaaatcatggcttgtccacaaacaatggtttctagacttaccactgccctggacctcgggagcttcaacaccccaagagacttggaacagagaagatttgctggttacatttaagacagctcatgcaaagaagcaggaagtagtcgtactaggatcacaagaaggagcaatgcacactgcgttgaccggagcgacagaaatccaaacgtctggaacgacaaaaatttttgcaggacacttgaaatgtagactaaaaatgaacaaactgaccttaaaagggatgtcatatgtgatgtgcacaggttcattcaagttagagaaagaagtggctgagacccagcatggaactgttctagtgcaggttaaatacgaaggaacagatgcaccatgcaagatccccttttcgacccaagatgagaaaggagtaacccagaatgggagattgataacagccaaccccatagtcactgacaaagaaaaaccagtcaacattgaggcagaaccaccttttggtgagagttacatcgtggtaggagcaggtgaaaaagctttgaaattaagctggttcaagaaaggaagcagcatagggaaaatgcttgaagcaactgcccgaggagcacgaaggatggccatcctaggagacaccgcatgggacttcggttctataggaggagtgttcacgtctgtgggaaaactggtacaccagatctttggaactgcatatggagttttgttcagcggtgtttcctggactatgaaaataggaatagggattctgctgacatggctaggattaaattcaaggagcgcgtccctttcgatgacgtgcattgcagttggcatggttacactgtacctaggagtcatggttcaggcggactcgggatgtgtaattaactggaaaggcagagaactcaaatgtggaagtggcatttttgtcaccaatgaagttcacacttggacagaacaatacaaattccaggccgactccccaaagagactatcagcagccattgggaaggcatgggaagagggtgtgtgtggaattcgatcagccactcgtctcgagaacatcatgtggaagcagatatcaaatgaactaaaccacatcttacttgaaaatgacatgaaattcacagtggtcgtaggagatgttagtgggatcttgacccaaggaagaaaaatgattgggccacaacccatggaacacaaatactcgtggaaaagctggggaaaagccaaaatcataggagcagatgtacagaacaccaccttcattatcgacggcccaaacaccccagaatgccctgatgaccaaagagcatggaacatttgggaagttgaggactatggatttggaattttcacgacaaatatatggttgaaattgcgtgactcctacacccaagtgtgtgacccccggctaatgtcagctgccatcaaggacagcaaggcagttcatgccgatatgggatactggatagaaagtgaaaagaacgagacctggaagctggcgagagcctccttcatagaagttaagacatgcgtctggccaaaatcccacactctatggagcaatggagttttggaaagtgaaatgataatcccaaagatatatggaggaccaatatctcagcacaactacagaccaggatattccacacaaacagcagggccgtggcacctaggcaagttggaactagattttgatttgtgtgagggtaccacagttgttgtggatgaacattgtggaaatcgaggaccatctcttagaaccacaacagtaacaggaaagataatccatgaatggtgctgtagatcttgtacgctaccccccttacgtttcaaaggagaagacgggtgttggtacggcatggaaatcagaccagtcaaggacaaggaagagaacctagttaagtcattggtctctgcagggtcaggagaagtggatagcttttcactaggactgctatgcatatcaataatgatcgaagaggtgatgagatccagatggagtagaaaaatgctgatgactggaacactggctgtgttcctccttctcataatgggacaattgacatggaatgatctgatcaggttatgcatcatggttggagccaatgcttcagacaggatggggatgggaacaacgtacctagctctgatggccacttttaaaatgagaccaatgttcgctgtcgggttattatttcgcagactaacatctagagaagttcttcttcttacgattggattgagtctggtggcatctgtggagctaccaaattccttggaggagctgggggatggacttgcaatgggcatcatgattttaaaattactgaccgactttcagtcacatcagctgtgggctgccctgctgtccttgacatttatcaaaacaactttttcattgcactatgcatggaagacagtggctatggtactgtcaattgtatctctcttccctttatgcctgtccacgacctctcaaaaaacaacatggcttccggtgctgttgggatctcttggatgcaaaccactaaccatgtttcttatagcagaaaacaaaatctggggaaggaaaagttggcccctcaatgaaggaatcatggctgttggaatagttagcatcctactaagttcactcctcaagaatgacgtgccgctagccggcccactaatagctggaggtatgctaatagcatgttatgttatatccggaagctcagccgatttatcactggagaaagcggctgagatctcctgggaagaagaagcagaacactctggtgcctcacacaacatactagtggaagtccaagatgatggaaccatgaagataaaagatgaagagagagatgacacactcaccattctcctcaaagcaactctgttggcagtctcaggggtgtacccaatatcaataccagcgaccctttttgtgtggtatttttggcagaaaaagaaacagagatcaggagtgctatgggacacacctagccctccagaagtggaaagagcagttcttgatgatggtatctatagaattctgcaaagaggactgttgggcaggtcccaggtaggagtaggagttttccaagaaggcgtgttccacacaatgtggcatgtcaccaggggagctgtcctcatgtatcaagggaagagactggaaccgagttgggccagtgtcaaaaaagacttgatctcatatggaggaggttggaggtttcaaggatcctggaacacgggagaagaagtgcaggtgattgctgttgaaccggggaaaaaccccaaaaacgtacagacagcgccgggcaccttcaagacccctgaaggcgaagttggagccatagccctagattttaaacccggcacatctggatctcccattgtgaacagagagggaaaaatagtaggtctttatggaaatggagtggtgacaacaagtggaacctacgtcagtgccatagctcaagctaaagcatcacaagaagggcccctaccagagattgaggacgaggtgtttaggaaaagaaacttaacaataatggacctacatccaggatcggggaaaacaagaagatatcttccagccatagtccgtgaggctataaaaaggaagctgcgtacgctaatcttggctcccacaagagttgtcgcttctgaaatggcagaggcgctcaagggaatgccaataaggtatcagacaacagcagtgaagagtgaacacacaggaagggagatagttgaccttatgtgccatgccactttcaccatgcgtctcctgtctcccgtgagagttcccaattacaacatgatcatcatggatgaagcacatttcaccgatccagccagcatagcggccagagggtacatctcaacccgggtgggcatgggtgaagcagctgcgatcttcatgacagccactcccccaggatcggtggaggcctttccacagagcaatgcagttatccaagatgaggaaagagacattcctgagagatcatggaactcaggctatgactggatcactgatttcccaggtaaaacagtctggtttgttccaagcattaaatcaggaaatgacattgccaactgtttaagaaagaatgggaaacgggtgatccaattgagcagaaaaacctttgatactgagtaccagaaaacaaaaaataatgactgggactatgtcgtcacaacagacatttccgaaatgggagcaaacttccgagccgacagggtaatagacccaagacggtgtttgaaaccggtaatactaaaagatggtccagagcgtgtcattctagccggaccgatgccagtgactgtggccagtgccgcccagaggagaggaagaattggaaggaaccaaaataaggaaggtgatcagtacatttacatgggacagcctttaaacaacgatgaggatcacgctcattggacagaagcaaaaatgctccttgacaacataaacacaccagaagggattatcccagccctctttgagccggagagaggaaaaagtgcagcaatagacggggaatacagactgcggggtgaagcaaggaaaacgttcgtggagctcatgagaagaggagatctacctgtctggctatcctacaaagttgcctcagaaggcttccagtactctgacagaaagtggtgctttgatggggaaaggaacaaccaggtgctggaggagaacatggacgtggagatctggacaaaagaaggagaaagaaagaaactacgaccccgctggctggacgccagaacatactctgacccacaggctctgcgcgagtttaaagagtttgcagcaggaagaagaagcgtctcaggtgatctaatattagaaatagggaaacttccacaacatttgacgcaaagggcccagaatgctctggacaacctggtcatgttgcacaactccgaacaaggaggaaaagcctatagacatgctatggaagaactaccagacaccatagaaacgttgatgctcctagctttgatagctgtgttaactggtggagtgacgctgttcttcctatcaggaagaggcctagggaaaacatctatcggcctactctgcgtgatggcttcaagcgtactgttatgggtggccagtgtggagccccattggatagcggcctccatcatactggagttctttctgatggtgctgcttattccagagccagacagacaacgcactccacaggacaaccagctggcatatgtggtgataggtttgttattcatgatattgacagtagcagccaatgagatgggattattggaaaccacaaagaaagacctagggattggccatgtggctgttgaaaaccaccaccatgccacaatgctggacgtagacttacgtccagcttcagcctggaccctctatgcagtggccacaacaatcatcactcccatgatgagacacacaattgaaaacacaacggcaaatatttccctgacagctattgcaaaccaggcagctatattgatgggacttgacaagggatggccaatatcgaagatggacataggagttccactcctcgccttggggtgctattcccaggtgaacccgctgacgctgatagcggcggtattgatgctagtggctcattacgccataattggacctggactgcaagcaaaagccactagagaagctcaaaaaagaacagcggccggaataatgaaaaatccaactgtcgacggaattgttgcaatagatttggaccctgtggtttatgatgcaaaatttgaaaaacagctaggccaaataatgttgttgatactttgcacatcacagattctcttgatgcggactacatgggccttgtgtgaatccatcacactggctactggacctctgaccacgctttgggagggatctccaggaaaattctggaacaccacgatcgcggtgtccatggcaaacattttcaggggaagttatctagcaggagcaggtctggccttctcattaatgaaatctctaggaggaggtaggagaggtacgggagcccaaggggaaacactgggagaaaaatggaaaagacagctaaaccaactgagcaagtcagaattcaacacttacaaaaggagtgggattatggaggtggatagatctgaagctaaagagggattgaaaagaggagaaacaaccaaacatgcagtgtcgagaggaacagccaaactgaggtggtttgtggagaggaaccttgtgaagccggaagggaaagtcatagacctcggttgtggaagaggtggctggtcatattattgtgctgggctgaagaaagtcacagaagtgaaaggatatacaaaaggaggacctggacatgaggaaccaatcccaatggcgacctatggatggaacctagtaaagctacactccgggaaagatgtattctttacaccacctgagaaatgtgacacccttttgtgtgatattggtgagtcctctccgaacccaactatagaagaaggaagaacgttacgtgttctaaagatggtggaaccatggctcagaggaaaccaattttgcataaaaattctgaatccctatatgccgagtgtggtggaaactctggagcaaatgcaaagaaaacatggaggaatgctagtgcgaaatccactctcaagaaattccactcatgaaatgtactgggtttcatgtggaacaggaaacattgtgtcagcagtaaacatgacatctagaatgttgctaaatcggttcacaatggctcacaggaagccaacatatgaaagagacgtggacttaggtgctggaacaagacatgtggcagtggaaccagaggtagccaacctagatatcattggccagaggatagagaatataaaaaatgagcataagtcaacatggcattatgatgaggacaatccatacaaaacatgggcctatcatggatcatatgaggttaagccatcaggatcagcctcatccatggtcaatggcgtggtgagattgctcaccaaaccatgggatgttatccctatggtcacacaaatagccatgactgacactacaccctttggacaacagagggtgtttaaagagaaagttgacacgcgcacaccaaaagcaaaacgaggcacagcacaaatcatggaggtgacagccaggtggttatggggttttctttctagaaacaaaaaaccaagaatctgcacaagagaggagttcacaagaaaagtcaggtcaaacgcagccattggagcagtgttcgttgatgaaaatcaatggaactcagcaaaagaagcggtggaagatgaacggttctgggaccttgtgcacagagagagggagctccataaacagggaaaatgtgccacgtgtgtttacaatatgatggggaagagagagaaaaaattaggagagttcggaaaggcaaaaggaagtcgtgcaatatggtacatgtggttgggagcacgctttctagagttcgaagcccttggtttcatgaacgaagatcactggttcagtagagagaattcactcagtggagtggaaggagaaggactccacaaacttggatatatactcagagacatatcaaagattccagggggaaatatgtatgcagatgacacagccggatgggacacaagaataacagaggatgatcttcagaatgaggccaaaatcactgacatcatggagcccgaacatgccctattggctacgtcaatctttaagctgacctaccaaaacaaggtggtaagggtgcagagaccagcaaaaaatggaaccgtgatggatgtcatatccagacgtgaccagagaggaagtggacaggtcggaacttatggcttaaacactttcactaacatggaggtccaactaataagacaaatggagtctgagggaatcttttcacccagcgaattggagaccccaaatttagccgaaagagttctcgactggttggaaaaacatggcgtcgaaaggctgaaaagaatggcaatcagcggagatgactgtgtggtgaaaccaactgatgacaggttcgcaacagccttaacagctttgaatgacatgggaaaagtaagaaaagacataccgcaatgggaaccttcaaaaggatggaatgattggcaacaagtgcctttttgttcacaccatttccaccagctgatcatgaaggatgggagggagatagtggtgccatgccgcaaccaagatgaacttgtgggtagggctagagtatcacaaggcgccggatggagcctgagagaaactgcatgcctaggcaagtcatatgcacagatgtggcagctgatgtacttccacaggagagacctgagactagcggccaatgccatctgttcagccgttccaattgattgggtcccaaccagccgcaccacctggtcgatccatgcccatcatcaatggatgacaacagaagacatgttgtcagtgtggaatagggtttggatagaggaaaacccatggatggaggataaaacccatgtatccagttgggaagatgttccatacttaggaaaaagggaagatcagtggtgtggatccctgataggcttaacagcaagggccacctgggccactaatatacaagtggccataaaccaagtgagaaggctcattgggaatgagaattatctagattacatgacatcaatgaagagattcaagaatgagagtgatctcgaaggggcactctggtaa

SEQ ID NO: 6326 - RNA, 9879 nt, synthetic construct
  misc_feature 1..9879: note = derived and/or modified CDS sequence (wt) from DENV-1__KR024708__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaactgaaacgtggatgtcctcagaaggagcctggaagcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtgctggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggatcagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattgccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggttcaagaaaggaagcagcatagggaaaatgttcgaagccaccgcccgaggagcgcgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaatttcaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaattataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagttaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttcttacaattggactaagcctggtggcatccgtggagctaccaaattctttagaggagctaggggacggacttgcgatgggcatcatgatgttaaaattgttgactgactttcagtcacaccagttgtggactaccttactgtctctgacattcatcaaaacaactctttcactggattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaactatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcactttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagagtcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaagagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaacttccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccattatcggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggcacgggagctcaaggggaaacattgggagaaaaatggaaaagacaactaaaccaactgagcaagtcagaatttaacacttacaaaaggagtggaattatggaggtggacaggtccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatcttcagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagctagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6327 - RNA, 9879 nt, synthetic construct
  misc_feature 1..9879: note = derived and/or modified CDS sequence (wt) from DENV-1__KR024705__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaactgaaacgtggatgtcctcagaaggagcctggaagcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacgccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacattcaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcaccatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaaccggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagtgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6328 - RNA, 9879 nt, synthetic construct
  misc_feature 1..9879: note = derived and/or modified CDS sequence (wt) from DENV-1__KR024706__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactggagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaactgaaacgtggatgtcctctgaaggcgcctggaggcagatacaaaaagtggagacttgggccttgagacacccaggattcacggtgatagccttttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacactcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactggggggagaagcaaggaaaacgttcgtggagctaatgaaaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaaccggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagctagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6329 - RNA, 9879 nt, synthetic construct
  misc_feature 1..9879: note = derived and/or modified CDS sequence (wt) from DENV-1__KR024707__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcttatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatgtttacatgggacagcctttaaataatgatgaggaccatgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactaaccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgttaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacctgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgtcgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6330 - RNA, 9879 nt, synthetic construct
  misc_feature 1..9879: note = derived and/or modified CDS sequence (wt) from DENV-1__KC172829__SS-prME
  source 1..9879: mol_type = other RNA
tctgtgaccatgctccttatgctgatgcccacagccttggcgttccatttgactacacgagggggagagccgcacatgatagtcagcaagcaggaaagaggaaagtcactcttgtttaagacctcagcaggtgtcaatatgtgcacccttatagcgatggatttgggagagttgtgtgaggacacaatgacttacaaatgccctcgaatcactgaggcggaaccagatgacgttgattgttggtgcaacgccacagacacatgggtgacctatggaacatgttcccaaactggcgagcaccgacgagacaaacgttccgtcgcactggccccacacgtgggacttggtttggaaacaagaaccgaaacgtggatgtcttctgaaggtgcttggaaacagatacaaagagtggaaacttgggccctgagacacccaggattcacggtgatagccctttttctagcacatgccataggaacatccatcacccagaaagggatcattttcattttgttaatgctggtaacaccatccatggccatgcgatgtgtgggaataggcagcagggacttcgtggaaggactgtcaggagcaacttgggtagatgtggtactggaacatggaagttgcgtaaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtagaagaacaagacgcgaactttgtgtgtcgacgaacgtttgtggacagaggctggggtaatggctgtgggctcttcggaaaaggaagcctaataacgtgtgccaagttcaagtgtgtgacaaaactggaaggaaagatagttcaatatgaaaacctgaaatattcagtaatagtcaccgtccacactggagaccagcaccaggtgggaaatgaaagcacagaacacgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacatcacaagaaacttggaacagacaagatttgttggtgacatttaagacagctcatgcaaagaagcaggaagtagtcgttctaggatcacaagaaggagcaatgcacactgcgttgaccggagcgacagaaatccaaacatctggaacgacaacaatttttgcaggacacttgaaatgtagactaaagatggacaaactgactctaaaagggatgtcatacgtgatgtgcacaggcacattcaagctagagaaagaagtggctgagacccagcatggaactgttctagtgcagattaaatacgaaggaacagatgcaccatgcaagatccctttttccacccaagatgaaaaaggagtaacccagaatgggagattgataacagctaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatattgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaattcaaggagcacgtccctttcgatgacgtgtattgcagttggcctagtaacactatacctaggagtcatggttcaggcggattcaggatgtgtagttaattggaaaggtagagaactcaaatgtggaagtggcatctttgtcaccaatgaagttcacacttggacagagcaatacaaatttcaagctgactccccaaagagattatcagcagccattgggaaggcatgggaggagggtgtgtgtggaattcgatcagcaactcgtctcgagaacatcatgtggaagcaaatatcaaatgaactgaatcacatcttacttgaaaatgacatgaaattcacagtggttgtaggagatgttgctgggatcttggctcaaggaaaaaaaatgattaggccacaacccatggaatacaaatactcgtggaaaagctggggaaaggctaaaatcataggggcagatgtacagaacaccactttcatcatcgacggtccaaacaccccagaatgccctgatgaccaaagagcatggaacatttgggaagttgaggactatggatttggaattttcacgacaaacatatggctgagattgcgtgactcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagtgaaatgataattccaaagatctatggaggaccaatatctcagcacaactacagaccaggatatttcacacaaacggcagggccatggcacctaggcaagttggaactggattttgatttgtgtgagggtaccacagttgttgtggatgaacattgtggaaaccgaggaccatctcttaggaccacaacagtcacaggaaagataattcatgaatggtgttgcagatcttgtacgctaccacccttacgttttagaggagaagatgggtgctggtacggtatggaaatcagaccagtcaaggaaaaggaagagaatctagtcaaatcaatggtctctgcaggatcaggggaagtggacagcttttcactaggactgctatgcatatcaataatgatcgaagaggtgatgagatccagatggagtagaaaaatgctgatgactggaacactggctgtgttcttccttctcataataggacaattgacatggaatgatctgatcagattatccatcatggttggagccaacgcttccgacaagatggggatgggaacgacgtacctagctctgatggccacttttaaaatgagaccaatgtttgctgtagggctattattccgcagactaacatccagagaggttcttcttctaacaattggattgagcttagtggcatctgtggagttaccaaattccttggaggagctgggggatggacttgcaatgggcattatgattttaaaattattgactgactttcaatcacatcagctgtgggctaccttgctgtccttgacattcatcaaaacaacgttttccttgcactatgcatggaagacaatggctatggtactgtcaattgtatccctcttccccttatgcctgtccacgacctcccaaaaaacaacatggcttccggtgctattgggatctcttggatgcaaaccactaaccatgtttcttataacagaaaacaaaatctggggaaggaaaagttggcccctcaatgaaggaatcatggctgttggaatagtcagcatcctactaagctcactcctcaaaaatgatgtgccgctagctgggccactaatagctggaggcatgctaatagcatgttatgttatatctggaagctcagccgatctatcgctagagaaagcggctgaggtctcctgggaagaagaagcagaacactctggtgcctcacataacatattagtggaggtccaagatgatggaaccatgaagataaaggatgaagagagagatgacacgctaaccattctccttaaagcaactctgttagcagtttcaggggtgtacccattatcaatacctgcgaccctctttgtgtggtacttttggcagaaaaagaaacagagatctggagtgttatgggacacacccagccctccagaagtggaaagagcagttcttgatgatggtatctatagaatcatgcagagaggactgttgggcaggtcccaggtaggggtaggagttttccaagaaaacgtgttccacacaatgtggcatgtcaccaggggagctgtactcatgtatcaagggaagagactggaaccgagctgggccagtgtcaaaaaggacctgatctcatatggaggaggttggaggcttcaaggatcctggaacacgggagaagaagtgcaggtgattgctgttgaaccagggaaaaaccccaaaaatgtacaaacagcgccgggcacctttaagaccactgaaggtgaagttggagccattgccctagattttaaacccggcacatctggatctcccatcgtgaacagagaaggaaaaatagtaggtctttatggaaatggggtagtgacaacaagtggaacctacgtcagcgccatagctcaagcaaaagcatcacaagaagggcccctaccagagattgaagacgaagtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatttcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttctcaggtaaaacagtttggtttgttccaagcattaaatcaggaaatgacattgccaactgtttaagaaagaatgggaaacgggtgattcaattgagcaggaaaacctttgacacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgtcattttagcaggaccgatgccagtgactgtggccagtgccgctcagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaataaccaggtgttggaggagaacatggatgtggagatctggacaaaagaaggagaaagaaagaaactacgaccccgctggctggatgccagaacatactcagacccactggccctgcgcgagtttaaagagtttgcagcaggaagaagaagcgtttcaggtgatttaatattagaaatagggaaacttccacaacacttgacgcaaagggcccagaatgccttggacaacctggttatgttgcacaactccgaacaaggaggaagagcatatagacatgcaatggaagaactaccagacaccatagaaacgttgatgctcctagctttgatagctgtgttgactggtggagtgacgctgttcttcctatcaggaaggggcctagggaaaacatctatcggcctactctgcgtgatggcttcaagcgtgctgctatggatggccagtgtggagccccattggatagcggcctccatcatactggagtttttcctgatggtgctgcttattccagagccagacagacaacgcactccgcaggacaaccagctggcatatgtggtgataggtttgttatttatgatactgacagtagcagccaatgagatgggactgctagaaaccacaaagaaagacttagggattggccatgtggctgatgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaatcaagcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcagccggaataatgaagaatccaaccgttgatggaattgttgcaatagatttggaccctgtggtttatgatgcaaaatttgagaaacaactaggccaaataatgttgttgatactatgcacatcacagatcctcttgatgcggaccacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaaggaaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactccgggaaagacgtattctttataccacctgagaaatgtgacacccttttgtgtgatattggtgagtcctctccaaacccaactatagaggaaggaagaacgctacgcgtcctaaagatggtggaaccatggctcagaggaaaccaattttgcataaagattctgaatccctacatgccaagtgtggtggaaactctggagcaaatgcaaagaaaacatggaggaatgctagtgcgaaacccactttcaagaaactctacccatgaaatgtattgggtttcatgtggaacaggaaacattgtgtcagcagtaaacatgacatccagaatgttgctaaatcgattcacgatggttcacaggaaaccaacatatgaaagagacgtggatctaggcgctggaacaagacatgtggcagtggaaccagaggtggccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgagcggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagtttgaagctcttggtttcatgaacgaagaccactggttcagtagagagaattcacttagcggagtggaaggagaaggactccacaaacttggatatatactcagagacatatcaaagatcccagggggaaacatgtatgcagatgacacagccggatgggatacaaggataacagaggatgatcttcagaatgaggccaaaattactgacatcatggaatccgaacatgccctactggctaagtcaatcttcaagctaacctaccaaaataaagtggtaagggtacagagaccagcaaaaaatggaactgtgatggatgtcatatccagacgtgaccagagaggaagtggccaggtcggaacttatggcttaaacactttcaccaacatggaagcccagctgataagacaaatggagtctgagggaatcttttcacccagcgaattagagaccccaaatttagccgagagagctctcgactggctggaaaaacatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacagggtgccggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccaccaccaatggatgacaacagaagacatgctgtcagtgtggaatagggtttggatagaggaaaacccatggatggaggacaaaacccatatatccagttgggaagacgttccatatttagggaaaagggaagatcaatggtgtggatccctgataggcttaacagcaagggccacttgggccaccaacatacaagtggccataagccaagtgagaagactaattgggaatgagaattatctagattacatgacatcaatgaagagattcaagaacgagagtgatcccgaaggggcactctggtga

SEQ ID NO: 6331 - RNA, 9879 nt, synthetic construct
  misc_feature 1..9879: note = derived and/or modified CDS sequence (wt) from DENV-1__EU359008__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgtttaagacctcagcaggtgtcaacatgtgcacccttatagcgatggatttgggagagttatgtgaggacacactgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgctggaacatggaagttgcgtcactaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagccttataacgtgtgctaagttcaagtgtgtgacaaaactggaaggaaaaatagttcaatatgaaaacttgaaatattcagtaatagtcaccgtccacactggagaccagcatcaggtgggaaatgaaagcacagaacatgggacaactgcaactataacacctcaagctcccacgacagaaatacagctgaccgactacggagctcttacattggattgttcacctagaacaggactagactttaatgaaatggtgttgttgacaatgaaagaaaaatcatggctagtccacaaacaatggtttctagacctaccactgccttggacctcgggagcttcaacaacacaagaaacttggaacagacaagatttgctggtgacatttaagacagctcatgcaaagaagcaggaagtagtcgtactaggatcacaagaaggagcaatgcacactgcgctgaccggagcgacggaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatctttggaactgcatatggagttttgttcagcggtgtttcctggaccatgaaaataggaataggggctctgctgacatggctaggattaaactcaaggagcacgtccctttcgatgacgtgcattgcagttggcttagtaacgctatacttaggagtcatggttcaagcggattcaggatgtgtaattaattggaaaggtagagaactcaaatgtggaagtggcatttttgtcaccaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttacttgaaaatgacatgaaattcacagtggttgtaggagacgttgctgggatcttggctcaagggaaaaaaatgattaggccacaacccatggaacacaaatactcgtggaaaagctggggaaaggctaaaatcataggggcagatgtacagaacaccacctttatcatcgacggcccaaataccccagaatgccctgatgatcaaagagcatggaacatttgggaagttgaggattatggatttggaattttcacgacaaacatatggctgaaattgcgtgactcctacacccaggtgtgtgaccaccggctaatgtcagctgccatcaaggacagcaaggcagttcacgctgacatggggtactggatagaaagtgaaaagaacgagacctggaagctggcaagagcctctttcatagaagtcaaaacatgtatctggccaaaatctcacactctatggagcaatggagttctggaaagtgaaatgataattccaaagatctatggaggaccaatatctcagcacaactacagaccaggatatttcacacaaacggcagggccgtggcacctaggcaagctggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttctttcttctcataatgggacaagtgacatggaatgatctgatcagattatgcatcatggttggagccaacgcttccgacaggatggggatgggaacgacgtacctagctctgatggccacttttaaaatgagaccaatgtttgctgtagggctactattccgcagactaacatccagagaagttcttcttctaacaattggattgagtctagtggcatctgtggagttacccaattccttggaggagctgggggatggacttgcaatgggcattatgattttaaaattattgactgacttccaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctattgggatctcttggatgcaaaccactaaccatgtttctcatagcagaaaacaaaatctggggaaggaaaagttggcccctcaatgaaggaatcatggctgttggaattgtcagtatcttactaagttcactcctcaaaaatgatgtgccgctagctggaccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttgtgggacacacctagccctccagaagtggaaagagcagttcttgatgatggtatctatagaatcatgcagagaggactgttgggcaggtcccaagtaggggtaggagtttttcaggaaaacgtgtttcacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagccccgggcacctttaagacccctgaaggcgaagttggagccattgccctagattttaaacccggcacatctggatctcccatcgtgaacagagaagggaaaatagtaggtctttatggaaatggagtagtgacaacaagtggaacctacgtcagtgccatagctcaagctaaagcatcacaagaagggcccctaccagagattgaagacgaggtgtttaggaaaagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgcttaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagctatccaagatgaggaaagagacattcctgagagatcatggaactcaggctatgagtggatcactgacttcccaggcaaaacagtttggtttgttccaagcatcaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctctgaaatgggagcaaatttccgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaacaaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgatagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagttcaaagagtttgcagcaggaagaagaagcgtctcaggtgatctaatattagaaatagggaaacttccacaacacttaacgcaaagggcccagaatgccttggacaacctggttatgttgcacaattccgaacaaggaggaagagcctatagacatgcaatggaagaactgccagacaccatagaaacgttgatgctcctagctttgatagctgtgttgactggtggagtgacgctgttcttcctatcaggaaggggcttagggaaaacatctatcggcctactctgcgtgatggcttcaagcgtactgctatggatggccagtgtagagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgactgccattgcaaaccaggcagctatcttgatgggacttgacaaaggatggccaatatcgaagatggacataggagttccacttctcgccttggggtgctattcccaagtgaatccactgacgctgacagcggcggtattgatgctagtggctcattacgctataattggacctggactgcaagcgaaagctactagagaagctcaaaaaaggacagcggccggaataatgaaaaatccaactgttgatggaatcgttgcaatagatttggaccctgtggtttatgatgcgaaatttgagaaacaactaggccaaataatgttgttgatactatgcacatcacagatccttttgatgcggactacatgggccttgtgcgaatccatcacactggccactggacctctgaccacgctctgggagggatctccaggaaaattttggaacaccacgatagcggtttccatggcaaacattttcagaggaagttatctagcaggagcaggtctggccttctcattgatgaaatccctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattctgcataaaaattctgaatccctacatgccaagtgtggtggaaactttggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatattattggccagaggatagagaacataaaacatgaacacaagtcaacatggcattatgatgaggacaatccatataaaacatgggcctatcatggatcatatgaggtcaagccatcaggatcagcctcatccatggtcaatggtgtggtgaaactgctcaccaaaccatgggatgtcatccccatggtcacacaaatagccatgactgacaccacaccctttggacaacagagggtgtttaaagagaaagttgacacacgcacaccaaaagcaaaacgaggcacagcacaaatcatggaggtgacagccaggtggttatggggttttctttctagaaacaagaagccaagaatttgtacaagagaggagtttacaagaaaagttaggtcaaacgcagccatcggagcagtgttcgttgacgaaaatcaatggaactcagcaaaagaagcagtggaagatgagcggttctgggaccttgtgcacagagagagggagcttcacaaacagggaaaatgtgctacgtgtgtttacaacatgatggggaagagagagaaaaagctaggagaatttggaaaggcaaaaggaagtcgcgcaatatggtacatgtggttgggagcacgctttctagagttcgaagctcttggtttcatgaacgaagaccattggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaactagagaccccaaatttagccgagagagttctcgactggctggaaaaatatggcgtcgaaaggctaaaaagaatggcaatcagtggagatgactgcgtagtgaaaccaattgatgataggtttgcaacagccttaacagctctgaatgacatgggaaaagtaagaaaagatataccgcaatgggaaccctcaaaaggatggaatgattggcaacaagtgcctttttgttcacaccacttccaccagctgatcatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaaccagccgtaccacctggtcgatccatgcccaccaccaatggatgacaacagaagacatgctgtcagtgtggaatagggtctggatagaggaaaacccatggatggaggacaaaacccatatatccagttgggaagatgttccatatttagggaaaagggaagatcaatggtgtggatccctgataggcttaacagcaagagccacctgggccaccaacatacaagtggccataaaccaagtgagaagactaattgggaatgagaattatctagattacatgacatcaatgaagagattcaagaacgagagtgatcccgaaggggcactctggtga

SEQ ID NO: 6332 - RNA, 9879 nt, synthetic construct
  misc_feature 1..9879: note = derived and/or modified CDS sequence (wt) from DENV-1__AY835999__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggatcattttcattttgttaatgctggtaacaccatccatggccatgcgatgcgtgggaataggcagcagggacttcgtggaaggactgtcaggagcaacctgggtagatgtggtactggaacatggaagttgcgtcaccaccatggcaaaagacaaaccaacattggacattgaactcttaaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggactagactttaatgaaatggtgttgttgacaatgaaagaaaaatcatggctagtccacaaacaatggtttctagacttaccactgccttggacttcgggagcttcaacatcacaagagacttggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcatttaagctagagaaagaagtggctgagacccagcatggaaccgttctagtgcagattaaatatgaaggaacagatgcaccatgcaagatcccttttttgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctgtaggaggagtgttcacgtctgttggaaaattagtacaccagatttttggaactgcatatggagttttgttcagcggtgtttcctggaccatgaaattaggaataggggttctgctgacatggctaggattaaactcaaggagcacgtccctctcgatgacgtgcattgcagttggcctagtaacactatacctaggagtcatggttcaggcggattcaggatgcgtaattaattggaaaggtagagaactcaaatgtggaagtggcatttttgtcaccaatgaagttcacacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggttcaagggaaaaaaatgattaggccacaacccatggaatacaaatactcgtggaaaagctggggaaaggctaaaatcataggggcagatgtacagaactccaccttcatcattgacggcccaaacaccccagaatgccctgatgaccaaagagcatggaacatttgggaagttgaggattatggatttggaattttcacgacaaacatatggctgaaattgcgtgactcctacacccaagtgtgtgatcaccggctaatgtcagctgccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcaacataactacagaccaggatatttcacacaaacggcagggccgtggcacctaggcaaattggaactggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaaaatgggtgctggtacggtatggaaatcagaccagtcaaggaaaaggaagagaatctagtcaaatcaatggtctctgcagggtcaggggaagtggacagcttttcactaggactgctatgcatatcaataatgatcgaagaggtgatgagatccagatggagtagaaaaatgctgatgaccggaatactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaacaattggattgagtctagtggcatctgtggagttaccaaattccttggaggagctgggggatggacttgcaatgggcattatgattttaaaattattgactgactttcaatcacatcagttgtgggctaccttgctgtccttgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatttggggaaggaaaagttggcccctcaatgaagggatcatggctgttggaatagtcagcatcctactaagttcactcctcaaaaatgatgtgccgctagctgggccactaatagctggaggcatgctaatagcatgttatgttatatctggaagctcagccgacctatcactagagaaagcagctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggtatctatagaattatgcagagaggactgttgggcaggtcccaagtaggggtaggagtttttcaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacagcgccgggcacctttaagacccctgaaggtgaagttggagccattgccctagattttaaacccggcacatctggatctcccatcgtgaacagagaaggaaaaatagtaggtctttatggaaatggagtagtgacaacaagtggaacctacgtcagtgccatagctcaaaccaaagcatcacaagaagggcccctaccagagattgaagacgaagtgtttaggaaaagaaacttaacaataatggacctacatccaggatcgggaaaaacaagaagatatcttccagccatagtccgtgaggccataaaaaggaagctgcgcacactaattctggctcccacaagggttgtcgcttccgaaatggcggaagcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcaatcttcatgacagccactcccccaggatcaatggaggcctttccacagagcaacgcagttatccaagatgaggaaagagacattcctgagagatcatggaactcaggctatgagtggatcactgacttcccaggtaaaacagtctggtttgttccaagcattaaagcagggaatgacattgccaactgcttaagaaagaatggaaaacgagtgattcaattgagcaggaaaacctttgatacagagtaccaaaaaacaaaaaataacgactgggactacgtcgtcacaacagacatctccgaaatgggagcaaattttcgggccgacagggtgatagacccaagacggtgtctgaaaccggtaatactaaaagatggtccagagcgtgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatatagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagacaccatagaaacattgatgctcctggctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatactggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtggacttacatccagcttcagcctggaccctctatgcagtggccacaacaattatcactcccatgatgaggcacacaatcgaaaacacaacggcaaacatttccctgacagccattgcaaaccaggcagccatattgatgggacttgacaaaggatggccaatatcgaagatggacataggagttccacttctcgccttggggtgctattcccaggtgaatccactgacgctgacagcggcgttgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgttgttgatactatgcacatcacagatcctcttgatgcggactacatgggccctgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatactaaaggaggacctggacatgaggaaccaatcccaatggcgacctatggatggaacctagtaaaactgcactccgggaaagacgtattctttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgcccaattggctaagtcaatcttcaagctaacctaccaaaataaggtggtaagggtacagagaccagcaaaaaatggaaccgtgatggatgtcatatccagacgtgaccagagaggaagtggccaggttggaacctatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggttcgcgacagccttaacagctctgaatgatatgggaaaagtaagaaaagacataccacaatgggaaccttcaaaaggatggaatgattggcaacaagtgcctttttgttcacaccacttccaccagctgattatgaaggatgggagggaaatagtggtgccatgccgcaaccaagatgaacttgtgggaagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggtcccaaccagccgcaccacctggtcgatccatgcccatcaccaatggatgacaacagaagacatgctgtcagtgtggaatagggtttggatagaggaaaacccatggatggaggacaaaacccgtatatccagttgggaagatgttccatatctaggaaaaagggaagatcaatggtgtggatctctgataggcttaacagcaagggccacctgggccaccaacatacaagtggccataaaccaagtgagaagactaattgggaatgagaattattcagattacatgacatcaatgaagagattcaagaacgagagtgaaccagaaggggcactctggtga

SEQ ID NO: 6333 - RNA, 9879 nt, synthetic construct
  misc_feature 1..9879: note = derived and/or modified CDS sequence (wt) from DENV-1__KP686070__SS-prME
  source 1..9879: mol_type = other RNA
tccgtgaccatgctcctcatgctgctgcccacagccctggcgttccatttgaccacacgagggggagagccacacatgatagttagcaagcaggaaagaggaaagtcactcttgtttaagacctctgcaggtgtcaacatgtgcaccctcattgcaatggatttgggagagttatgtgaggatacaatgacctacaaatgcccccggatcactgaagcggaaccagatgatgttgattgctggtgcaatgccacagacacatgggtgacctatgggacgtgttctcagactggcgaacaccgacgggataaacgttctgtcgcattggccccacacgtggggcttggtctcgaaacaagaaccgaaacgtggatgtcctctgaaggcgcctggaggcagatacaaaaagtggagacttgggccttgagacacccaggattcacggtgatagccctttttttagcacatgccataggaacatccattacccagaaagggatcatcttcattttgctgatgctggtgacaccatcaatggccatgcgatgcgtgggaataggcaacagagacttcgttgaaggactgtcaggagcaacatgggtggatgtggtactggagcatggaagctgtgtcaccaccatggcaaagaataaaccaacattggacattgaactcttgaagacggaggtcacgaaccctgccgtcttgcgcaaactgtgcattgaagctaaaatatcaaacaccaccaccgattcaagatgtccaacacaaggagaagctacactggtggaagaacaagacgcgaactttgtgtgtcgacgaacattcgtggacagaggctggggtaatggttgtggactattcgggaagggaagcttactaacgtgtgctaagtttaagtgtgtgacaaaacttgaaggaaagatagttcaatatgaaaacttaaaatattcggtgatagtcactgtccacactggggaccagcaccaggtaggaaatgagactacagaacatggaacaattgcaaccataacacctcaagctcccacgtcggaaatacagctgactgactacggagcccttacattggactgctcacctagaacagggctggactttaatgagatggtgctgttgacaatgaaagaaaaatcatggcttgtccacaaacaatggtttctagacttaccattaccttggacctcgggggcttcaacatctcaagagacttggaacagacaagatctgctggtcacatttaagacagctcatgcaaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagctagagaaggaagtggctgagacccagcatggaactgtcctagtgcaggttaaatatgaaggaacagatgcaccatgcaagattccaatttcaacccaagatgagaaaggagtgacccagaatgggagattgataacagccaatcccatagttactgacaaagaaaaaccagtcaacattgaaacagaaccaccctttggtgagagctacatcgtgataggggcgggtgaaaaagctttgaaactaagctggtttaagaaaggaagcagcatagggaaaatgttcgaagccaccgcccgaggagcacgaaggatggctatcctgggagacacagcatgggacttcggttccataggaggggtgttcacatctgtgggaaaattggtacaccaggtttttggaaccgcatatggggtcctgttcagcggtgtttcttggaccatgaaaataggaatagggattctgctgacatggctaggattgaattcaaggagcacgtcactctcgatgacgtgcattgcagttggcatggtcacactgtacctaggagtcatggttcaagcggactcggggtgtgtgatcaactggaagggcagagaactcaagtgtggaagtggcatctttgtcactaatgaagtccacacttggacagagcaatacaaattccaggctgactccccaaaaagactatcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgccaatggaatcttgacccaaggaaaaaagatgattaggccacaacccatggaacacaaatactcatggaaaagctggggaaaagccaaaatcataggagcagatacacagaatactaccttcatcatcgatggcccagacactccagaatgccccgatgaccagagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttaatttgtgtgaaggcaccacagttgttgtggatgaacattgtggaaatcgaggtccatctcttagaactacaacagtcacaggaaagataatccatgaatggtgctgcagatcctgcacgctaccccccttacgcttcagaggagaagacggatgttggtatggcatggaaatcagaccagtcaaggagaaggaagagaatctagtcaggtcaatggtctctgcagggtcaggagaagtggacagtttttcattgggactactatgcgtatcaataatgattgaagaagtgatgagatccagatggagtagaaagatgctgatgactggaacactggctgttttcttccttcttataatgggacaactgacatggaatgatctgatcaggttatgcatcatggttggagccaatgtctcagacagaatggggatgggaacaacgtacctagctttaatggccacttttaaaatgagaccgatgttcgctgttgggctattatttcgcagactaacatccagagaggtgctccttctcacaattggactaagcctggtggcatccgtggagctaccaaattctttagaggagctaggggacggacttgcgatgggcatcatgatgttaaaattgttgactgattttcagtcacaccagttgtggactaccttactgtctctgacattcatcaaaacaactctttcactagattatgcatggaagacaatggctatggtattgtcaatcgtatctctctttcctctatgtctatccacgacctctcaaaaaacaacatggcttccggtgttgttaggatcctttggatgtaaaccactaaccatgtttcttataacagaaaacaaaatttggggaaggaaaagttggcccctcaatgaaggaattatggctgttggaatagtcagcattttactaagttcactcctcaaaaatgacgtgccactagccggcccactaatagctggaggcatgctgatagcatgttacgtcatttccggaagctcagccgatttatcattggagagagcggctgaggtctcctgggaagaagaagcagaacactctggtgcctcacacaacatactagtggaggtccaagatgatggaaccatgaaaataaaagatgaagagagagatgacacgctcactatactcctcaaagcaactttgttggcagtttcaggggtgtacccaatgtcaataccagcaaccctttttgtgtggtatttttggcagaaaaagaaacagagatcaggagtcttgtgggacacacccagccctccagaagtagaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccagggaaaaacccaaagaatgtacagacaacgccgggcaccttcaagacccctgaaggcgaagttggagccatagccctagatttcaaacctggcacatctggatctcccatcgtgaacagagaggggaaaatagtaggtctttatggaaatggagtggtgacaacaagtggaacctacgtcagtgccattgcccaagctaaagcgtcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaaaggagatagtcgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatcttcatgacagccactcccccaggatcggtagaggcctttccacagagcaatgcagttatccaagatgaggaaagagacattcctgagagatcatggaactcaggctacgactggatcactgacttcccaggaaaaacagtctggtttgttccaagcatcaaatcaggaaatgacattgccaactgcttaagaaaaaacgggaaacgggtgatccaattgagcagaaaaacctttgacactgaataccagaaaacgaaaaacaatgattgggactatgttgtcacaacagacatttccgaaatgggagcaaatttccgggccgatagggtaatagacccaaggcggtgcttgaagccggtaatactaaaagatggcccagagcgcgtcattctggccggaccaatgccagtgaccgcggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaatacgccagaagggattatcccagccctctttgagccagagagagaaaagagtgcagcaatagacggggagtatagactgcggggagaagcaaggaaaacgttcgtggagctaatgagaagaggggatctaccagtttggctatcttacaaagttgcctcagaaggcttccagtactccgacagaagatggtgctttgacggggaaaggaacaaccaggtgttggaggagaacatggacgtggagatctggacaaaagaaggagaaagaaagaaattgcgacctcgctggttagatgccagaacctactctgatccactggccctgcgcgagtttaaggagttcgcagcaggaagaagaagtgtctcaggtgacctaatattagaaatagggaaactcccacagcatttgacgctaagggcccagaatgctttggacaacttggtcatgttgcacaattccgaacaagggggaaaagcctatagacatgctatggaagaactaccagacaccatagaaacattgatgctactagccttgatagctgtgctgactggtggagttacgttgtttttcctatcaggaaaaggtctagggaaaacatccattggcctactttgtgtaatggcctcaagtgtactgttatggatggccagtgtggagccccattggatagcggcctccatcatactagagttttttctgatggtgctgcttattccagagccagacagacagcgtactccacaggacaatcaactagcatatgtggtgataggtttgttattcatgatattgacagtggcagccaatgagatgggattactggaaaccacaaagaaagacctggggattggccatgtagtcgccgaaaaccaccaccatgccacaatgctagacatagacttacatccagcttcagcctggaccctctatgcagtagccacaacaattatcactcccatgatgagacacacaattgaaaacacaacggcaaacatttccctgacagctattgcaaatcaggcggctatattaatgggacttgacaagggatggccaatatcgaagatggacataggagtgccacttctcgccttagggtgctattcccaggtgaacccattgacactgacagcggcggtgtcaatgttagtggctcattatgccataattggacctggactgcaagcaaaagctaccagagaagcccaaaaaaggactgcggccggaataatgaaaaatccaactgtagacgggattgttgcaatagatttggatcctgtggtttatgatgcaaaatttgaaaaacagctaggccaaataatgttactaatactctgcacatcacagattctcttgatgcggactacatgggccttatgtgaatctatcacactggctactggacccttgaccactctctgggagggatctcctggaaaattctggaataccacgatagcagtgtccatggcaaacatcttcaggggaagttatttagcaggggcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatccgaagccaaggagggactgaaaagaggagaaacaaccaaacatgcagtgtcgagaggaacagccaaacttaggtggtttgtggagaggaaccttgtgaaaccggaagggaaagtgatagacctcggttgtggaagaggtggctggtcatattactgcgctgggctgaagaaggtcacagaagtaaagggatacacaaaaggaggacccggtcatgaggaacctatcccaatggcgacttatggatggaacatagtgaagctacactctggaagggatgtattctttacaccacctgagaaatgtgacacccttttgtgtgatattggtgagtcctctccgaatccaactatagaagaaggaagaacgttacgtgttctaaagatggtggaaccatggctcagaggaaatcagttttgcataaaaatcctaaatccttatatgccaagtgtggtagaaactctggagcaaatgcaaagaaaacatggagggatgctagtgcgaaacccactctcaagaaattccacccatgaaatgtactgggtctcatgtggaacaggaaacattgtgtcggcagtgaacatgacatccagaatgctgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacataagtcaacatggcattatgatgaggacaatccatacaaaacatgggcctatcatggatcatatgaggtcaagccatcagggtcagcctcatccatggtgaatggcgtggtgagattgctcaccaagccatgggatgttatccccatggtcacacaaatagctatgactgataccacacccttcggacaacagagggttttcaaagagaaagttgacacacgcacaccaagaccaaaacgaggcacagcacaaattatggaggtgacagccaagtggttgtggggattcctctctagaaataaaaaacccagaatctgcacaagagaggagttcacaagaaaagttaggtcaaacgcagcaattggagcagtgtttgttgatgaaaaccaatggaactcagcaaaagaagcagtggaagacgaaaggttttgggacctcgtgcacagagagagggagcttcataaacagggaaaatgtgccacgtgtgtctacaatatgatgggtaaaagagagaaaaaactaggagagtttggaaaggcaaaaggaagtcgtgcaatatggtacatgtggttgggagcacgctttctagaatttgaagcccttggcttcatgaatgaagaccactggttcagtagggagaattcactcagtggagtggaaggagaaggactacataaacttggatacatactcagagacatatcaaagattccagggggaaatatgtatgcagacgacacagctggatgggacacaagaataacagaggatgatctccagaatgaggctaaaatcaccgacatcatggagcctgaacatgctctactggctacgtcaatcttcaagctgacctatcaaaataaggtggtaagggtgcaaagaccagcaaaaagtggaaccgtgatggacgtcatatccagacgtgaccagagaggaagtggacaggtcggaacttatggcctaaacactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaggtgagaaaagacataccgcaatgggaaccttcaaaaggatggaatgactggcagcaagtgcctttctgttcacaccacttccaccaactgattatgaaggatgggagggagatagtggtgccatgccgcaaccaagatgaacttgtgggcagggccagagtatcacaaggcgccgggtggagcctgagagaaactgcttgcctaggcaagtcatatgcacaaatgtggcagctgatgtacttccacaggagagacctgagactggcggctaatgctatctgttcagccgttccagttaattgggtcccaaccagccgcaccacctggtcgatccatgcccaccatcaatggatgacaacagaagacatgttgtcagtatggaatagggtttggatagaggaaaacccatggatggaggacaaaactcatgtatccagctgggaagatgttccatacttaggaaaaagggaagatcaatggtgtggatctctgataggcttaacagcaagagccacctgggccaccaacatacaagtggccataaaccaagtgagaaggcttattgggaacgagaattatttagactacatgacatcaatgaagagattcaagaatgagagtgatcccgaaggagccctctggtaa

SEQ ID NO: 6334 - RNA, 9876 nt, synthetic construct
  misc_feature 1..9876: note = derived and/or modified CDS sequence (wt) from DENV-1__KF672760__SS-prME
  source 1..9876: mol_type = other RNA
tccgtgaccatgctcctcatgctgctgcccacagccctggcgtttcatttgaccacacgagggggagagccacacatgatagttagtaagcaggaaagaggaaagtcactcttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcgcatgctataggaacatccatcactcaaaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgtggactattcggaaagggaagtctattgacgtgtgccaagttcaagtgtgtgacaaaactagagggaaagatagttcaatatgaaaacttaaaatattcagtgatagtcactgtccacactggggaccagcaccaggtgggaaacgagaccacagaacatggaacaattgcaaccataacacctcaagctcccacgtcggaaatacagctgactgactacggagccctcacactggactgctcacctagaacagggctggactttaatgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacacagcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgtcctagtgcaggtcaaatatgaaggaacagacgcgccatgcaagatccctttctcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacatcaggtttttggaaccgcatatggggttctgtttagcggtgtttcttggaccatgaaaataggaatagggattctgctgacatggttgggattaaattcaaggagcacgtcactttcgatgacgtgcattgcagttggcatggtcacactgtacctaggagtcatggttcaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaggcatgggaggagggcgtatgtgggattcgatcagccacgcgtcttgagaacatcatgtggaagcaaatatcaaatgaattgaaccacattctacttgagaatgacatgaaattcacagtggttgtaggagatgccaacggaattttggcccaagggaaaaaaatgattaggccacaacctatggaacacaaatattcatggaaaagctggggaaaagctaaaatcataggagcagacatacaaaataccaccttcatcatcgacggcccagacaccccagaatgtcccgatggccaaagagcatggaacatttgggaagttgaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctccttcatagaagtcaagacatgcacctggccgaaatctcacactctatggagcaatggagtcttggaaagtgaaatgataatcccaaagatatttggaggaccaatatctcagcacaactacagaccagggtatttcacacaaacagcagggccatggcacctaggtaagttggaactggattttgatttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagtcaggtcaatggtctctgcagggtcaggagaagtggatagtttttcattaggaatactatgcgtgtcaatgatgattgaagaagtgatgagatccagatggagtagaaagatgctgatgactggaacactggctgttttcctccttcttataatgggacaactgacatggaatgatctgattaggttatgcatcatggttggagctaacgcttcagacaggatggggatgggaacaacgtacctagccttgatggctacttttaaaatgagaccaatgttcgctgttgggctattattccgcagactaacatccagagaagttcttctcctcacgattggattaagcctggtggcatgcgtggagctaccaaattctttggaggagctaggggatggacttgcaatgggtatcatgatgttaaaattgttgactgaatttcagccacaccagttatggaccaccttattgtctctgacatttgtcaaaacaactctctcactggattatgcatggaaaacaacggctatggtactgtctatcgtatctctctttcctttatgcctgtctacaacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtacttttggcagaaaaagaaacagagatcaggagtgttatgggacacacccagccctccggaagtggaaagagcagttcttgatgatggcatctatagaatcttgcaaagaggactgttggggaggtcccaagtaggagtgggagtcttccaagacggcgtgtttcacacaatgtggcacgttaccaggggagctgtccttatgtaccaagggaagagactggaaccaagctgggccagtgtcaaaaaggacttgatctcatatggaggaggttggaggttccaaggatcatggaacacaggagaagaagtgcaggtgatagctgttgaaccaggaaaaaaccccaaaaatgtacagacaacgccgggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgttagtgccattgcccaagctaaagcatcacaggaagggcctctaccagagattgaggacgaggtgtttaagaaaagaaacttaacaataatggacctgcacccaggatcagggaaaacaagaagataccttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggcccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgcactgttatggatggccagtgtagagccccattggatagcggcctccatcatactagagttctttttgatggtgctgctcattccagaaccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacgatgctggacgtagacctacacccagcttcagcctggaccctctatgcagtagccacaacagttatcactcccatgatgagacacacaattgaaaatacaacggcaaacatttccctgacagccattgcaaatcaggcagccatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacattggctactggacccctgaccactctctgggagggatctccaggaaaattctggaataccacaatagcagtgtccatggcaaacatcttcaggggaagttatttagcaggagcaggtctggctttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcgaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggttttatgaatgaagatcactggtttagtagagagaattcactcagtggagtggaaggagaaggactgcacaaacttggatacatactcagagacatatcaaagattccggggggaaatatgtatgcagatgatacggccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggaatctgaaggaatctttttacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcgaaaggatggaatgattggcagcaagtgcctttttgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaacgctatctgctcagccgtcccagttgattgggtcccagccagccgcacaacctggtcaatccatgcccaccaccaatggatgacaacagaagacatgttatcagtgtggaatagagtttggatagaggaaaacccatggatggaggacaaaactcatgtatccagttgggaagaagttccatacctaggaaaaagggaagaccaatggtgtggatccctgataggcttgacagcgagggccacctgggccaccaacatacaagtagccataaaccaagtgagaaggctcatcgggaatgagaattatttagattacatgacatcaatgaagagattcaagaatgagagtgatcccgaaggagcactctgg

SEQ ID NO: 6335 - RNA, 9876 nt, synthetic construct
  misc_feature 1..9876: note = derived and/or modified CDS sequence (wt) from DENV-1__KF672759__SS-prME
  source 1..9876: mol_type = other RNA
tccgtgaccatgctcctcatgctgctgcccacagccctggccttccatttgactacacgagggggagagccacacatgatagtcagcaagcaggaaagaggaaagtcactcttgtttaagacctctgtaggtgtcaacatgtgcactctcattgcgatggatttgggagagttatgtgaggacacaatgacctacaaatgcccccggatcactgaggcggaaccagatgatgttgactgctggtgcaatgccacagacacatgggtgacctatgggacgtgttctcaaaccggcgaacaccgacgagacaaacgttccgtcgcactggccccacacgtgggacttggtctagaaacaagaactgaaacgtggatgtcatctgaaggcgcctggaaacaaatacaaaaagtggagacttgggctttgcgacacccaggattcacggtgatagcccttttcttggcacatgccataggaacatccatcacccagaaagggatcattttcattttgctgatgctggtaacaccatcaatggccatgcgatgcgtgggaataggcaatagagacttcgttgaaggactgtcaggagcaacgtgggtggacgtggtactggagcatggaagctgcgtcaccaccatggcaaaaaacaaaccaacattggacattgaactcttgaaaacggaggtcacgaaccctgccgtcctgcgcaaactgtgcattgaagccaaaatatcaaacaccaccaccgattcaagatgtccaacacaaggagaagccacactggtggaagaacaagacgcgaactttgtgtgtcgacggacgttcgtggacagaggctggggtaatggctgcggactatttggaaaaggaagtctactgacatgtgctaagttcaagtgtgtgacaaaactagaaggaaagatagttcaatatgaaaacttaaaatattcagtgatagtcactgtccacactggggaccagcaccaggtaggaaacgagactacagaacatggaacaattgcaaccataacacctcaagctcctacgtcggaaatacagctgaccgactacggagccctcacattggactgctcacctagaactgggctggactttaatgagatggtgctactgacaatgaaagaaaaatcatggcttgtccacaaacaatggtttctagacttaccactgccttggacttcgggagcttcaacatcccaagagacttggaacagacaagatttgctggtcacattcaagacagctcatgcaaagaaacaggaagtagtcgtgctgggatcacaggaaggagcaatgcacactgcgctgactggggcgacagaaatccagacgtcaggaacgacaacaatttttgcgggacacctgaaatgtagactaaaaatggacaaactgactttaaaagggatgtcatatgtgatgtgcacaggctcatttaagctagagaaggaagtggctgagacccagcatggaactgttttagtgcaggttaaatacgaaggaacagatgcaccatgcaagatcccttttttgacccaagatgagaaaggagtgacccagaatgggagattgataacagctaatcctatagttactgataaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggccatcctgggagacactgcatgggacttcggctctataggaggattgttcacgtctgtgggaaaattgatacaccaggtttttggaactgcatatggggttctgttcagcggtgtttcttggaccatgaaaataggaatagggattctgctgacatggttgggattaaattcaaggagcacgtcactttcaatgacgtgcattgcagttggcatggtcacactgtacctaggagtcatggttcaagcggactcgggatgtgtgatcaactggaagggcagagaactcaaatgtggaagtggcatctttgtcactaatgaagtccacacttggacagagcaatataaattccaggctgactccccaaaaagactgtcagcagccattgggaaggcatgggaggaaggcgtgtgtggaattcgatcagccacgcgtcttgagaacatcatgtggaagcaaatatcaaatgaattgaactacatcctacttgaaaatgacatgaaattcacagtggttgtaggagacgttaatggaattttggcccaagggaaaaaaatgattagaccacaacccatggaacacaaatactcatggaaaagttggggaaaagccaagatcataggagcagacatacagaacaccacctttatcattgacggcccagatactccagaatgccccgatgaccaaagagcatggaacatttgggaagttgaggactacgggttcggaattttcacgacaaacatatggctgaaattgcgtgactcccacacccaaatgtgtgaccatcggctaatgtcagctgccatcaaggacagcaaagcagtccatgctgatatggggtactggatagaaagtgaaaagaacgagacctggaagctagcgagagcctcctttatagaagtcaagacatgcatctggccgaaatcccacactctatggagtaatggagttttggaaagtgaaatggtaatcccaaagatatatggaggaccaatatctcagcacaactacagaccagggtatttcacacaaacagcagggccatggcacctaggcaagttggaattggattttgacttgtgtgaaggtaccacagttgttgtagatgaacattgtggatatcgaggcccatctctcagaactacaacagttacaggaaagataatccatgaatggtgttgcagatcctgcacgttaccccccttacgcttcagaggagaagacggatgttggtatggcatggaaatcagaccagttaaggagaaggaggagaacctagttaggtcaatggtctctgcagggtcaggagaagtggacagtttttcattaggaatactatgcgtatcaatattgattgaagaagtaatgagatccagatggagtagaaagatgctgatgactggaacactggctgttttcctccttctcataatgggacaactgacatggaatgatctgatcaggttatgcatcatggttggagccaatgcttcagacaggatggggatggggacaacgtacctagccttgatggccactttcaaaatgagaccaatgttcgctgttgggctattatttcgcagactaacatgcagagaagttcttcttctcacggttggattaagcctggtggcatccgtggagctaccaaattctttagaggagctaggggatggacttgcaatgggcatcatgatgttaaaattattgactgacttccagccacaccagttatggaccaccctattgtctctaacatttatcagaacatctctttcattggattatgcatggaagacaatggctatggcactgtcaatcgtatctctctttcctttgtgtctgtctacgacctcccaaaaaacaacatggcttccggtgctgttaggatcttttggatgtaaaccattaaccatgtttctcataacagaaaacaaaatctggggaaggaaaagctggcccatcaatgaaggaattatggctgttggaatagtcagcatcctactaagttcactcctcaaaaatgatgtgccgctagccggcccactaatagctggaggcatgctaatagcatgttatgtcatatctggaagctcagctgatttatcattggaaaaagcggctgaggtatcctgggaagaagaagcagaacactccggcacctcacacaacatattagtggaggtccaagatgatggaactatgaaaataaaagatgaagagagggatgatacactcaccatactcctcaaagcaactctgctggcagtctcaggagtgtacccaatgtcaataccggcaactctttttgtgtggtatttttggcagaaaaagaaacagagatcaggagtgttatgggacacacccagccctccgaaagtggagagggcagttcttgatgatggcatttatagaatcttgcaaagaggactgttgggtaggtcccaagtaggagtgggagttttccaagacggcgtgttccacacaatgtggcacgtcaccaggggagctgtccttatgtaccaagggaagaggctggaaccaagctgggccagtgtcaaaaaagacttgatctcatacggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatccggatctcccatcgtgaacagagagggaaaaatagtaggtctttatggaaatggagtggtgacaacaagtggaacctacgtcagtgccatcgctcaagctaaagcaacacaagaagggcctctaccagagattgaggacgaggtgtttaagaaaagaaacttaacaataatggacctgcatccaggatcagggaaaacaagaagatatcttccagccatagtccgtgaggccataaaaaggaagctgcgcacgctaatcttggctcccacaagagttgtcgcctctgaaatggcagaggcgctcaagggaatgccaataagataccagacaacagcagtgaagagtgaacatacaggaagggagatagttgacctcatgtgccatgccacttttaccatgcgtctcttatctccagtgagagttcccaattacaacatgattatcatggatgaagcacactttactgatccagccagcatagcagccagagggtacatctcaacccgagtgggcatgggtgaagcagctgcgatcttcatgacagccactcccccaggatcggtggaggcctttccacagagcaatgcagttatccaagatgaggaaagagacattcctgagagatcatggaactcaggctacgactggatcactgattttccaggtaaaacagtttggtttgttccaagcatcaaatcaggaaatgacattgctaactgtttaagaaagaacggaaaacgggtgattcaactgagcaggaaaacctttgacactgagtaccagaaaacaaaaaacaatgactgggactacgttgtcacaacagacatttccgaaatgggagcaaatttccgggccgacagggtaatagatccaaggcggtgcttgaaaccggtaatactaaaggaaggtccagagcgcgttattctagccggaccgatgccagtgactgtggccagtgccgcccagaggagaggaagaattggaaggaaccaaaacaaagaaggtgatcagtacatttacatgggacagcctttaaataatgatgaggatcacgctcattggacagaagcaaaaatgctccttgacaatataaacacaccagaagggatcatcccagccctctttgagccagagagagaaaaaagtgcagcaatagacggggagtacagactgcggggagaagcaaggaaaacgttcgtggagctcatgagaagaggagatttaccagtttggctatcctacaaagttgcctcagaaggtttccaatactccgacagaagatggtgctttgatggggaaaggaataaccaggtgttggaggagaacatggacgtggagatctggacaaaggaaggagaaagaaagaaattgcgaccccgctggttggatgctagaacatactctgacccactggccctgcgcgagtttaaagagtttgcagcaggaagaagaagtgtctcaggtgacctaatattggaaataggaaaacttccacaacatttgacgctaagagcccagaatgctctggacaacttggtcatgttgcacaattccgaacaaggaggaaaagcctacagacatgctatggaagaactaccagacaccatagaaacattgatgctcctagctttgatagctgtgctgactggtggagtgacgctgttcttcctatcaggaaaaggtctagggaaaacatccattggcctactctgtgtgatggcctcaagcgcactgttatggatggccagtgtggagccccattggatagcggcttccatcatattagagttctttctgatggtgctgctcattccagagccagacagacagcgcactccacaggacaaccagttagcatatgtggtgataggtttgttattcatgatactgacagtggcagctaatgagatgggattgttggaaaccacaaagaaagacctagggattggccatgtagccgtcgaaaaccaccaccatgccacaatgctggacgtagacctacgtccagcttcagcctggaccctctatgcagtagccacaacagttatcacccccatgatgagacacacaattgaaaatacaacggcaaatatttccctgacagccatcgcaaaccaggctgctatattgatggggcttgataagggatggccaatatcgaagatggatataggagttccacttctcgccttagggtgctattcccaggtgaacccattgacactaacagcggcggtgttgatgttagtggctcattatgccataattggaccaggactgcaagcaaaggccactagagaagctcaaaaaaggacagcggccggaataatgaaaaatccaaccgtagacgggattgtcacaatagacttggatcctgtggtttatgatgcaaaatttgaaaaacagctaggtcaaataatgttactgatactttgtacatcacagattctcttgatgcggaccacatgggccttgtgtgaatccatcacactggctactggacccttgaccactctttgggagggatctccaggaaaattctggaacaccacgatagcagtgtccatggcaaacatcttcaggggaagttatctagcaggagcaggtctggccttctcgttgatgaagtctttaggaggaggtaggagaggaacgggagctcaaggggaaacactgggagaaaaatggaaaagacagctaaatcaactgagcaagtcagaatttaacacctacaaaaagagtgggattatggaggtggacagatccgaagctaaagagggattgaaaagaggagaaacaaccaaacatgcagtgtcgagaggaacagccaaactgaggtggtttgtggagagaaacctcgtgaaaccagaagggaaagtcatagacctcggttgtgggagaggtggttggtcatattactgcgctgggctgaagaaagtcactgaagtgaagggatacacaaaaggaggacctggacatgaggaacccatcccaatggcgacctatggatggaacttggtaaagctacactctgggaaagatgtattcttcacaccacctgagaaatgtgacacccttttgtgtgacattggtgagtcctctccaaatccaactatagaagaaggaagaacattacgtgttctaaagatggtggaaccatggcttagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaacataaaaaatgaacataagtcaacatggcattatgatgaagacaatccatacaaaacatgggcctatcatggatcatatgaggtcaaaccatcaggatcagcctcatccatggtgaatggcgtggtgagattgctcaccaaaccatgggatgttatccccatggtcacacaaatagctatgactgataccacacccttcggacaacagagggtgtttaaagagaaagttgacacgcgcacaccaagagcaaaaagaggcacagcacaaatcatggaggtgacagccaagtggttatggggtttcctatccagaaacaaaaaacccagaatctgcacaagagaggagttcacaagaaaagttaggtcaaacgcagcaataggagcagtgtttgttgatgaaaaccaatggaactcagcaaaagaagcagtggaagacgaaaggttttgggatctcgtgcacagagagagggagcttcataaacagggaaaatgtgccacgtgtgtttacaatatgatggggaagagagaaaaaaaattaggagagttcggaaaagcaaaaggaagtcgtgcaatatggtacatgtggctgggagcacgctttctagagtttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggccacgtcaatttttaaactgacctaccaaaataaggtggtgagggtgcaaagaccagcaaaaagtgggaccgtgatggatgtcatatccagacgtgaccagagaggaagtggacaggtcggaacttatggcttaaatactttcaccaatatggaggtccaattaataagacaaatggagtctgaaggaattttctcacccagcgaattggaaacccccaatctagctaagaaagttcttgactggctggaaaaacatggcgctgaaaggctgaaaagaatggcaattagcggagatgattgtgtggtgaaaccaattgatgacaggttcgcaacagccttaacagctttgaatgatatgggaaaagtaagaaaagacataccgcagtgggaaccttcaaaaggatggaatgactggcagcaagtccctttctgttcacaccacttccatcagctgatcatgaaagatggaagagaaatagtggtgccatgccgcaaccaagatgaacttgtgggcagggctagagtatcacaaggcgctggatggagcctgagagaaactgcttgcctaggcaagtcatatgcacaaatgtggcagctgatgtactttcacaggagagacctgagactagcggctaatgctatctgttcagccgtcccagttgattgggtcccaaccagccgcaccacctggtcgatccatgcccaccaccaatggatgacaacagaagacatgttatcagtgtggaatagggtttggatagaggaaaacccatggatggaagacaaaactcatgtatccagttgggaagaagttccatacctagggaaaagggaagatcaatggtgtggatccttgataggtttgacagcaagggccacctgggccactaatatacaagtagccataaaccaagtgagaaggcttatcgggaatgagaattatctagattatatgacatcaatgaagagattcaagaatgagagtgatcccgaaggggcactctgg

SEQ ID NO: 6336 - RNA, 9876 nt, synthetic construct
  misc_feature 1..9876: note = derived and/or modified CDS sequence (wt) from DENV-1__KF672761__SS-prME
  source 1..9876: mol_type = other RNA
tccgtgaccatgctcttcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcggacaccgacgagacaaacgttccgtggcactggccccacacgtgggactcggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgtcgaacgtttgtggacagaggctggggtaacggctgcggactattcggaaaaggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagattaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagttaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtaggaaaattggtacaccaggtttttggaaccgcgtatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggattcgggatgtgtaatcaactggaagggcagagaactcaaatgtggaagtggcatttttgtcactaatgaggtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggtcgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactgacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaagacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcactggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcctggaattcaggctacgactggatcactgattttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttccgaaatgggagcaaatttccgggccgacagggtaatagacccaagacggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcattccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttaacgctaagagcccagaatgctctggataacttggtcatgttgcacaattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctctgggagggatctccaggaaaattctggaataccacgatagcagtgtccatggcaaacatctttaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagaaggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggtagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccctatggtcacacaaatagctatgactgataccacaccctttggacaacagagagtgtttaaagagaaagttgacacgcgcacaccaagagcaaaacgaggcacagcacagattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaacgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggtgccgaaaggctgaaaagaatggcaatcagcggagatgattgtgtagtgaaaccaattgatgacaggttcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtggccataaaccaagtgagaaggctcatcgggaatgagaattatctagattacatgacatcaatgaagagattcaagaatgagagtgatcccgaaggggcactctgg

SEQ ID NO: 6337 - RNA, 9876 nt, synthetic construct
  misc_feature 1..9876: note = derived and/or modified CDS sequence (wt) from DENV-1__KF672762__SS-prME
  source 1..9876: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaatatgtgcactctcattgcgatggatttgggagagttatgtgaggacacaatgacctacaaatgccctcggatcactgaggcggaaccagatgacgttgactgctggtgcaatgccacagacacatgggtgacctatgggacgtgttctcaaaccggcgaacaccgacgagacaaacgttccgtggcactggccccacatgtgggacttggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactatgcattgaagctaaaatatcaaacaccaccaccgattcaagatgtccaacacaaggagaggctacactggtggaagaacaagacgcgaactttgtgtgtcgtcgaacgtttgtggacagaggctggggtaatggctgcggactattcggaaaaggaagcctattgacgtgtgccaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaatagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggagcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggttcttggaaccgcatatggggttctgttcagcggtgtatcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcatctggccgaaatcccacactctatggagtaatggagttttggaaagtgaaatgataatcccaaagatatatggaggaccaatatctcagcacaactacagaccagggtatttcacacaaacagcagggccatggcacctaggcaagttggaattggattttgacttgtgtgaaggtaccacagttgttgtggatgaacattgtggaaatcgaggtccatctctcagaactacaacagtcacaggaaagataatccatgaatggtgttgcagatcctgcacgttaccccccttacggttcagaggagaagacggatgttggtatggcatggaaattagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtagcatccgtggagctaccaaattctttggaggagctaggggatggacttgcaatgggtatcatgatgttaaaattattgactgaatttcagccacaccagttatggaccaccttactgtctttgacatttatcaaaacaactctttcattggattatgcatggaagacaacggctatggtactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatttatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccattgcccaagctaaagcatcacaggaaggacctctaccagagattgaggacgaggtgtttaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtagaacagtctggtttgttccaagcattaaatcaggaaatgacattgccaactgtttaagaaagaacggaaaacgggtaatccaattaagcagaaaaacctttgacactgagtaccagaaaacaaaaaacaatgactgggactatgttgtcacaacagacatctccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatcctagagttctttttgatggtgctgctcattccagagccagacagacagcgcactccacaggacaaccagctagcatatgtggtgataggtttgttattcatgatactgacagtggcggccaatgagatgggattattggaaaccacaaagaaagacctggggattggccatgtagccgccgaaaaccaccaacatgctacaatgctggacgtagacctacgtccagcttcagcctggaccctctatgcagtagccacaacagttatcactcccatgatgagacacacaattgaaaatacaacggcaaacatttccttgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttaatgcggaccacatgggccttgtgtgaatctatcacactggctactggacccctgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtggtattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggtagaacgttacgtgttctaaagatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagttgtgagattgctcacaaaaccatgggatgttatccccatggtcacacaaatagctatgactgataccacaccctttggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtatatgtggctgggagcacgttttctggagttcgaagcccttggcttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttaccaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgtgtagtgaaaccaattgatgacaggttcgcaacagccttaatagctctgaatgacatgggaaaagtaagaaaagacataccgcagtgggaaccttcaaaaggatggaatgattggcagcaagtgcctttctgttcacaccattttcaccaattgatcatgaaggatgggagggaaatagtggtgccatgtcgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagcagtcccaattgattgggtcccaaccagccgcacaacctggtcaatccatgcccaccaccaatggatgacaacagaagacatgttatcagtgtggaatagggtttggatagaggaaaacccatggatggaggacaaagctcatgtatccagttgggaagaagttccatacctagggaagagggaagaccaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctgg

SEQ ID NO: 6338 - RNA, 9879 nt, synthetic construct
  misc_feature 1..9879: note = derived and/or modified CDS sequence (wt) from DENV-1__JF459993__SS-prME
  source 1..9879: mol_type = other RNA
tctgtgaccatgctcttcatgctgctgcccacatccctggcattccatctgaccacccgagggggagagccgcacatgatagttagcaagcaggaaagaggaaagtcacttttgtttaagacctctgcaggtgtcaacatgtgtacccttattgcaatggatttgggagagttgtgtgaggacacaatgacctacaaatgcccccggatcactgaaacggaaccagatgacgttgactgttggtgcaacgccacggagacatgggtgacttatggaacatgttctcaaactggtgaacaccgacgagacaaacgttctgttgcactggcaccacacgtagggcttggtctagaaacaagaaccgaaacgtggatgtcctctgaaggcgcttggaaacaaatacaaaaagtggagacctgggctctgggacacccaggattcacggtgatagctctttttctagcacatgccataggaacatccatcacccagaaaggaattatttttattttgctgatgctggtaactccatccatggccatgcggtgcgtgggaataggtaacagggacttcgtggaaggactgtcaggagctacgtgggtggatgtggtactggagcatggaagttgtgtcactactatggcaaaagacaaaccaacactggatattgaactcttaaagacggaggtcacaaacccagccatcctgcgcaaactgtgcattgaagccaaaatatcaaatactaccaccgattcgagatgtccaacacaaggagaagccacgctggtggaagaacaagacacgaactttgtgtgtcgacgaacgttcgtggacagaggctggggcaatggttgtgggctatttggaaaaggtagcttaataacgtgtgctaagtttaagtgtgtgacaaaactggaaggaaagatagttcaatatgaaaatttaaaatattcagtgatagtcaccgtccacactggagaccagcaccaagttgggaatgaaactacagaacatggaacaactgcaaccataacacctcaagctcctacgtcggaaatacagctgacagactacggagctttaacactggactgttcacctagaacagggctagacttcaatgagatggtgttgttgacaatgaaagaaaaatcatggctcgtccacaaacaatggtttctagacttaccgctgccttggacctcgggggcttcaacatcccaagagacttggaatagacaagacttgctggtcacatttaagacggctcatgcaaagaagcaggaagtagttgtactaggatcacaagaaggagcgatgcacactgcgctgactggagcaacagaaatccaaacgtctggaacgacaacaattttcgcaggacacctgaaatgcagactgaaaatggataaactgactttaaaaggggtatcatatgtaatgtgcacaggctcattcaagctagaaaaggaagtggctgagacccagcatggaactgttctagtgcaggttaagtacgaaggaacagatgcaccatgtaagatccccttctcatcccaagatgagaagggagtaatccagaatgggagattgataacagccaaccccatagtcactgacaaagaaaaaccagtcaacattgaggcggagccaccttttggtgagagctacatcgtggtaggagcaggtgagaaagctttgaaactaagctggttcaagaagggaagcagtatagggaaaatgtttgaagcaactgcccgtggagcacgaaggatggccattctgggagacactgcatgggacttcggttctataggaggagtgttcacgtccgtgggaaaactggtacaccagatctttggaactgcgtacggagttttgttcagcggtgtttcttggaccatgaaaataggaatagggattctgctgacatggctaggattaaattcaaggagcacgtccctttcaatgacgtgtatcgcagttggcatggtcacactgtacctaggagtcatggttcaggcggactcgggatgtgtaattaactggaaaggcagagaactcaaatgtggaagcggcatttttgtcactaatgaagttcacacctggacagagcaatacaaattccaggccgactccccaaaaagactatcagcagccattgggaaggcatgggaggagggtgtgtgtggaattcgatcagccactcgtctcgagaacatcatgtggaagcaaatatcaaatgaactgaaccacatcttacttgaaaatgacatgaaattcacagtggttgtaggagatgttgctgggattttggctcaagggaaaaagatgattaggccacaacccatggaatacaaatactcgtggaaaagctggggaaaggctaaaatcataggggcagatgtacagaacgccaccttcatcatcgacggcccaaacacccctgaatgtcctgatgaccaaagagcatggaacatttgggaagttgaggactatggatttggaattttcacgacaaacatatggctgaaattgcgtgactcctacacccaagtgtgtgaccaccggctaatgtcagctgccatcaaggacagcaaggcagttcacgctgacatgggatactggatagaaagtgaaaagaacgagacctggaagctggcaagagcctctttcatagaagttaaaacatgtgtctggccaaaatcccacactctatggagcaatggagttctggaaagtgaaatgataattccaaagatctatggaggaccaatatcccagcacaaccacagaccaggatatttcacacaaacggcagggccgtggcacctaggcaagttggaactggattttgatttgtgtgagggtaccacagttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaacctagtcaaatcaatggtctctgcagggtcaggggaagtggacagcttttcactagggctgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacgtacctagctctgatggccacttttaaaatgagaccaatgtttgctgtagggctattattccgcagactaacatccagagaagttcttcttctaacaattggactgagtctagtggcatctgtggagctaccaaattccttggaggagctgggggatggacttgcaatgggcattatgattttaaaattattgactgactttcaatcacatcagctgtgggctaccttgctgtccttgacatttatcaaaacaacgttttccttgcactatgcatggaagacaatggctatggtactgtcaattgtctctctcttccccttatgcctgtccacgacctcccaaaaaacaacatggcttccggtgctattgggatctcttggatgcaaaccactaaccatgtttcttatagcagaaaacaaaatctggggaaggaaaagttggcctctcaatgaaggaatcatggctgttggaatagtcagcatcctactaagttcactcctaaaaaatgatgtgccgctagctgggccactaatagctggaggcatgctaatagcatgttatgttatatctggaagctcagccgatctatcactagagaaagcggccgaggtctcttgggaagaagaagcagaacactctggtgcctcacacaacatattagtggaggtccaagatgatggaaccatgaagataaaggatgaagagagagatgacacgctaaccattctcctcaaagcaactctgctagcagtttcaggggtgtacccattatcaataccagcgaccctttttgtgtggtacttttggcagaaaaagaagcagagatctggggtgttatgggacacacctagccctccagaagtggaaagagcagttcttgatgatggtatttatagaattatgcagagaggactgttgggcaggtcccaagtaggggtaggagtttttcaagaaaacgtgttccacacaatgtggcatgtcaccaggggagctgtactcatgtatcaagggaagagactggagccgagctgggccagtgtcaaaaaagacctgatctcatatggaggaggctggaggcttcaaggatcctggaacacaggagaagaagtgcaggtgattgctgttgaaccagggaaaaaccccaaaaatgtacaaacagcgccaggcacctttaagacccctgaaggcgaagttggagctattgccctagattttaaacccggcacatctggatctcccatcgtgaacagagaaggaaaaatagtaggtctttatggaaatggagtagtgacaacaagtggaacctacgtcagcgccatagctcaagctaaagcatcacaagaagggcccctaccagagattgaagacgaggtgtttaggaagagaaacttaacaataatggacctacatccaggatcggggaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatggaaaacgggtgattcaattgagcaggaaaacctttgatacagagtaccaaaaaacaaaaaataacgactgggactacgtcgtcacaacagacatctccgaaatgggagcaaatttccgggccgacagggtgatagacccaagacggtgtctgaaaccggtaatactaaaagatggtccagagcgtgttattttagcaggaccgatgccagtgactgtggccagtgccgcccagaggagaggaagaattggaaggaaccacaataaggaaggtgatcagtacatctacatgggacagcctttaaacaacgatgaagatcacgctcactggacggaagcaaaaatgctccttgataatataaacacaccagaagggattatcccagccctcttcgagccggagagagaaaagagtgcagcaatagacggggaatacagactgcggggtgaagcaaggaaaacttttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctgatattagaaatagggaaacttccacaacatttgacgcaaagggcccagaatgccttggacaacctggttatgttgcacaactccgaacaaggaggaagagcctatagacatgcactggaagaactgccagacaccatagaaacgttgatgctcctagctttgatagctgtgttaactggtggagtgacgctgttcttcctatcaggaaggggcctagggaaaacatctattggcctactctgcgtgatggcttcaagcgcactgctatggatggccagtgtggagccccattggatagcggcctccatcatactggagttcttcctgatggtgctgctcattccagagccagacagacaacgcactccgcaggacaaccagctggcatatgtggtgataggtctgttattcatgatactgacagtagcagccaatgagatgggactgctggaaaccacaaagaaagacttagggattggccatgtggctgttgaaaatcaccaccatgcctcaatgctggacgtagacttacacccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaatccattgacgctgacagcggcggtattgatgctagtggctcattacgccataattggacctggactgcaagcgaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggctactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactaaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaagaaccaatcccaatggcgacctatggatggaacctagtaaagctgcactccgggaaagacgtattctttataccacctgagaaatgtgacacccttttatgtgatattggtgagtcctctccaaacccaactatagaggaaggaagaacgctacgcgtcctaaagatggtggaaccatggcttagaggaaaccaattttgcataaaaattctgaatccctacatgccaagtgtggtggaaactctggagcaaatgcaaagaaaacatggaggaatgctagtgcgaaatccactttcaagaaattctactcatgaaatgtactgggtttcatgtggaacaggaaacattgtgtcagcagtaaacatgacatccagaatgttgttaaatcgattcacaatggctcacaggaaaccaacatatgaaagagatgtggacctaggcgccggaacaagacatgtggcagtggaaccagaggtagccaacctagatatcattggtcagaggatagagaacataaaacatgaacataagtcaacatggcattatgatgaggacaatccatataaaacatgggcctatcatggatcatatgaggtcaagccatcaggatcagcttcatccatggtcaatggcgtggtgaaactgctcaccaaaccatgggatgtcatccccatggtcacacaaatagccatgactgacactacaccctttggacaacagagggtgtttaaagagaaagttgacacacgcacaccaaaagcaaaacgaggcacagcacaaatcatggaggtgacagccaggtggttatggggttttctttctagaaacaagaaaccaagaatttgtacaagagaggagttcacaagaaaagttaggtcaaacgcagccattggagcagtgttcgttgatgaaaaccaatggaactcagcaaaagaagcagtggaagatgagcggttctgggaccttgtgcacagagagagggagcttcacaaacagggaaaatgtgccacgtgtgtttacaacatgatggggaagagagagaaaaaactaggagagttcggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagattccagggggaaacatgtatgcagatgacacagccggatgggatacaaggataacagaggatgaccttcagaatgaggccaaaattactgacatcatggaacccgaacatgccctactggctaagtcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgaggaaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgctcacaccacttccaccagctgattatgaaggatgggagggaagtagtggtgccatgccgcaaccaagatgaacttgtgggtagggctagagtatcacaaggcgctggatggagcctgagagaaactgcatgcctaggcaagtcatatgcacaaatgtggcagctgatgtacttccacaggagagacttgagactagccgctaatgctatctgttcagccgttccagttgattgggtcccaaccagccgcaccacctggtcgatccatgcccaccaccagtggatgacaacagaagacatgctgtcagtgtggaatagggtttggatagaggaaaacccatggatggaggacaaaacccatgtatccagttgggaagatgttccatatttaggaaaaagggaagatcaatggtgtggatccctgataggcttaacagcaagggccacctgggccaccaacatacaagtggccataaaccaagtgagaagactaattgggaatgagaattatctagattacatgacatcaatgaagagattcaaaaacgagagtgatcccgaaggggcactctggtga

SEQ ID NO: 6339 - RNA, 9876 nt, synthetic construct
  misc_feature 1..9876: note = derived and/or modified CDS sequence (wt) from DENV-1__KF672763__SS-prME
  source 1..9876: mol_type = other RNA
tccgtgaccatgctcctcatgctgctgcccacagccctggcattccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaacaaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagtttaagtgtgtgacaaaactagaaggaaagatagttcaatatgaaaacttgaaatattcagtgatagtcaccgtccacactggggatcagcaccaggtgggaaacgagactacagaacatggaacaattgcaaccataacaccccaagctcctacgtcggaaatacagctgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcaggacacctgaaatgcagactaaaaatggataaactgactttaaaagggacgtcatatgtgatgtgcacaggctcatttaagctagagaaggaagtggctgagacccagcatggaactgttctagtgcaggtcaaatacgaaggaacagatgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggtaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctgatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagcgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtattttacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattgtttcgcagactaacatccagagaagttcttcttctcacgattggattaagcctgatggcatccgtggagctaccaaattctttggaggagctaggggatggacttgcaatgggtatcatgatgttaaaattattgactgaatttcagccacatcagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagctcactcctcaaaaatgatgtgccgttggccggcccactaatagctggaggcatgctaatagcatgttatgtcatatccgggagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacaaagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccgggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgttcaagaaaagaaacttaacaataatggacctccatccaggatcaggaaaaacaagaagatatcttccagccatagtccgtgaggccataaaaaggaaactgcgtacgttgatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattatcatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactatgttgtcacaacagacatttccgaaatgggggcaaatttccgggctgacagggtaatagacccaaggcggtgcttgaaaccagtaatactaaaagatggtccagagcgtgttattctagccggaccgatgccagtgactgtggccagtgctgcccaaaggagaggaagaattggaaggaaccagaacaaggaaggtgatcagtatgtttacatgggacaacctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgccatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccatagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacttacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacgaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcggaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagctgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctgg

SEQ ID NO: 6340 - RNA, 9876 nt, synthetic construct
  misc_feature 1..9876: note = derived and/or modified CDS sequence (wt) from DENV-1__KF672764__SS-prME
  source 1..9876: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacatccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggttgcggattattcggaaaaggaagcctattgacgtgtgccaagttcaagtgtgtgacaaaactagaaggaaagatagttcaatatgaaaacttgaaatattcagtgatagtcaccgtccacactggggatcagcaccaggtgggaaacgagactacagaacatggaacaattgcaaccataacacctcaagctcctacgtcggaaatacagctgactgactatggagccctcacgttggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaggatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatggaactgttctagtgcaggtcaaatacgaaggaacagatgcgccatgcaagatccctttttcgacccaagatgagaaaggagtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaatccgatcagccacgcgtctagagaacatcatgtggaagcaaatatcaaatgaattgaaccacattctactagaaaatgacataaaattcacagtggttgtaggaaatgctaatggaattttgacccaagggaaaaaaatgattaggccacaacccatggaacacaaatactcatggaaaagctggggaaaagctaaaatcataggagcagacatacaaaataccaccttcatcatcgacggcccagatactccagaatgccctgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaatgaaacctggaagctggcgagagcctcgttcatagaagtcaagacatgcatttggccgaaatcccacacactatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaagtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttattgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaaaacaaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagctgatctatcattggagaaagcggctgaggtatcctgggaagaagaagcagaacactccggtacctcacacaacatattagtagaggtccaagatgatggaactatgaaaataaaagatgaagagagggatgacacactcactatactcctcaaagcaactttgctggcagtctcgggagtgtatccaatgtcaataccagcaactctttttgtgtggtatttttggcagaaaaagaaacagagatcaggagtgttatgggacacacccagccctccggaagtggaaagagcggttcttgatgatggcatctacagaatcttgcaaagaggactgttgggcaggtcccaagtaggagtgggagttttccaagacggcgtgttccacacaatgtggcacgttaccaggggagctgtccttatgtaccaagggaagaggctggaaccaagctgggccagtgtcaaaaaggacttgatctcatatggaggaggttggaggttccaaggatcatggaacacgggagaagaagtgcaggtaatagctgttgaaccaggaaaaaaccccaaaaatgtacagacaacgccgggtaccttcaagactcctgaaggcgaagttggagctatagctctagattttaaacccggcacatctgggtctcccatcgtgaacagagagggaaaaatagtgggtctttatggaaatggagtggtgacaacaagtggaacctacgtcagtgccatagcccaagctaaagcatcacaggaagggcctctaccagaaattgaggacgaggtgtttaagaaaagaaacttaacaataatggacctccatccaggatcaggaaaaacaagaagatatcttccagccatagtccgtgaggccataaaaaggaaactgcgtacgttaatcttggcccccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcagaaaaacctttgacactgagtaccagaaaacaaaaaacaatgactgggactacgttgtcacaacagacatttccgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcacaattccgaacaaggaggaaaagcctatagacatgctatggaggaactaccagacaccatagaaacactgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctgggagttccacttctcgccttagggtgctattcccaggtgaacccattgacactgacagcggcggtgttgatgttggtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactaggagagaaatggaaaagacagttaaaccaactgagcaagtcagaattcaacacctacaaaaggagtgggattatggaggtggacagaactgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggcagaacgttacgtgttctaaagatggtggaaccatggctcagaggcaaccaattctgcataaaaatcctaaatccttacatgccaagtgtggtagaaactctggagcaaatgcaaagaaaacatggcgggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcacttggtttcatgaatgaagatcactggtttagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaattaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggataaaactcatgtatccagttgggaagaagttccatacctagggaaaagggaagatcaatggtgtgggtccctgataggcttgacagcgagggccacctgggccaccaacatacaagtagccataaaccaagtgagaaggctcatcgggaatgagaattatctagattacatgacatcaatgaagagattcaagaatgagagtgatcctgaaggggcactctgg

SEQ ID NO: 6341 - RNA, 9879 nt, synthetic construct
  misc_feature 1..9879: note = derived and/or modified CDS sequence (wt) from DENV-1__EU863650__SS-prME
  source 1..9879: mol_type = other RNA
tctgtgaccatgctcctcatgctgctgcccacagtcttgacgttccatttgaccacccgagggggagagcctcacatgatagttagcaaacaggaaagaggaaagtcacttttgtttaagacctctgcaggtgtcaacatgtgcacccttattgcaatggacctgggagagttatgtgatgacacgatgacctacaaatgtccccggatcactgagacggaaccagatgacgttgactgttggtgcaatgccacggagacatgggtgacctatggaacatgttctcaaactggtgaacaccgacgagacaaacgttccgttgcactggcaccacacgtagggcttggtctagaaacaagaaccgaaacgtggatgtcctctgaaggcgcttggagacaaatacaaaaagtggagacatgggctctgagacacccaggatttacggtgatagccctttttctagcacatgccataggaacatccatcacccagaaagggattattttcattttgctgatgctggtgactccatccatggccatgcgatgcgtgggaataggcaacagagacttcgtggaaggactgtcaggagctacgtgggtggatgtagttctggagcatggaagttgcgtcactaccatggcaaaagacaaaccaacactggacattgaactcctgaagacggaggtcacaaaccctgccgtcctgcgcaaactgtgtatagaagctaaaatatcaaataccaccactgactcgagatgtccgacacaaggagaagccacgctggtggaagaacaagacacgaactttgtgtgtcgacgaacattcgtggacagaggctggggcaatggttgtggactattcggaaaaggtagcttaataacgtgtgctaagtttaagtgtgtgacaaaattggaaggaaagatagtccaatatgaaaacttaaaatattctgtgatcgttaccgtccacactggagaccagcaccaagttggaaatgagactacagaacatggaacaattgcaaccataacacctcaagctcctacgtcggaaatacaactgaccgactacggagctctaacactggattgttcacctagaacagggctagactttaatgagatggtgttgctgacaatgaaagaaaaatcatggctcgtccacaaacaatggtttctagacttaccactgccttggacctcaggggcctcaacgtcccaagagacttggaacagacaagacttgctggtcacgtttaagacagctcatgcaaagaagcaggaagtagtcgtactaggatcacaagaaggagcaatgcacactgcgttgactggagcgacagaaatccaaacgtctggaacgacaacaatttttgcaggccacctgaaatgcagattaaaaatggacaaactaactctaaaaggaatatcatatgtaatgtgcacaggcttattcaagttagagaaggaagtggctgagacccagcatggaactgttctagtacaggtcaaatacgaaggaacagatgcaccatgcaagattcccttttcgtcccaagatgagaaaggagcaacccagaatgggagattggtaacagccaaccccatagtcactgacaaagaaaaaccagtcaacattgaagcggagccaccctttggtgagagctacatcgtggtaggagcaggtgaaaaagctttgaaactaagctggttcaagaagggaagcagtatagggaaaatgtttgaagcaactgcccgtggagcacgaaggatggccatcctgggagacaccgcatgggacttcggctctataggaggagtgttcacgtctgtgggaaaactggtacaccagatctttggaactgcgtatggagttttgttcagcggtgtttcttggaccatgaaaataggaatagggattctgctgacatggctgggattaaactcaaggagcacgtccctttcaatgacgtgtatcgcagttggcatggtcacactgtacctaggagtcatggtccaggcggactcgggatgtgtaatcaactggaaaggcagagaactcaaatgtggaagcggcatttttgtgactaatgaagttcacacctggacagagcaatacaaattccaggctgactccccaaagagactatcagcagccattgggaaggcatgggaggagggtgtgtgtggaattcgatcagccactcgtctcgagaacatcatgtggaagcaaatatcaaatgaattaaaccacatcttacttgaaaatgacatgaaatttacagtggtagtaggagacgttagtggaatcttggcccaaggaaagaaaacgattaggccacaacccatggaacacaaatactcgtggaaaagttggggaaaagccaaaatcattggagcagatgttcagaacactaccttcatcatcgacggcccaaacaccccagaatgccccgatgaccaaagagcatggaacatctgggaagttgaagactatggatttggaattttcacgacaaacatatggttgaaattgcgtgattcctacacccaagtgtgtgaccatcgactaatgtcggctgccatcaaggatagcaaagcagtccatgctgacatggggtactggatagaaagtgaaaagaacgagacttggaagttggcaagagcctccttcatagaagtcaagacatgcgtctggccaaaatctcacactctatggagccatggagtcctggaaagtgagatgataatcccaaagatatatggaggaccaatatctcagcacaattacagaccaggatatttcacacaaacagcagggccgtggcacttaggcaagttggaactagattttgatttgtgtgaaggtaccacagtggttgtggatgaacattgtggaaatcgcggaccatctcttagaaccacaacagtcacaggaaagataatccatgaatggtgctgcagatcttgcacgttaccccctctacgtttcaaaggagaagacgggtgctggtacggcatggaaattagaccagtcaaggagaaggaagagaacctagttaagtcaatggtctctgcagggtcaggagaagtggacagtttttcactaggactgctatgcatatcaataatgatcgaagaggtaatgagatccagatggagcaggaaaatgctgatgactggaacattggttgtgttcctccttctcacattgggacaattgacatggaacgatctgatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccctagacgagctaggggatggacttgcaatgggcatcatgatattgaaattactgactgattttcaatcacatcagctatgggccactttgctgtctctaacatttgtcaaaacaactctttcactgcactatgcatggaagacaatggccatgatactgtcaattgtatccctcctccctttatgcctgtccacgacttctcaaaaaacgacatggcttccagtgcttctgggatctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcatgttatgtcatatccggaagctcggccgatttatcactggagaaagcagctaaggtctcctgggaagaagaagcagaacactctggcgcctcacacaatatactagtcgagatccaagatgatggaaccatgaagataaaggatgaagagagagatgacacgatcaccatcctcctcaaagcaaccctgctggcaatctcaggggtgtatccaatgtcaataccggcgactctctttgtgtggcatttttggcagaaaaagaaacagagatcaggagtgttatgggacacacccagccctccagaagtggaaaaagcagtccttgatgatggcatttatagaattctccaaagaggattgttgggcaggtctcaggtaggagtaggagttttccaagaaggcgtattccacacaatgtggcacgtcaccaggggagctgttctcatgtaccaagggaagagattggaaccaagctgggccagtgtcaaaaaagacttgatctcatatggaggaggttggaggtttcaaggatcctggaacacgggagaagaagtgcaggtgattgctgttgaaccggggaagaacccaaaaaatgtacagacagcgccaggtaccttcaagacttctgaaggcgaagttggagccatagctctagacttcaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacatccaggatcgggaaaaacaagaagataccttccagccatagtccgtgaggccataaaaagaaagctgcgcacgctagttctagctcccacaagagttgtcgcctctgaaatggcagaggcgctcaagggaatgccaataaggtatcagacaacagcagtgaagagtgaacacacgggaaaggagatagttgaccttatgtgtcacgccactttcactatgcgtctcctttctcctgtgagagttcccaattataacatgataattatggatgaagcacattttaccgatccagccagcatagcagccagagggtacatctcaacccgagtgggtatgggtgaagcagctgcgattttcatgacagccacccccccgggatcggtggaggcctttccacagagcaatgcagttatccaagatgaggaaaaagacattcctgaaagatcatggaactcaggctatgactggatcactgacttcccaggcaaaacagtctggtttgttccaagcatcaaatcaggaaatgacattgccaactgtttaagaaagaatggtaaacgggtgatccaattaagcaggaaaacttttgacactgagtatcagaaaacaaaaaataacgactgggactatgttgtcacaacagacatatccgaaatgggagcaaactttcgagctgacagggtaatagacccaaggcggtgcctgaaaccggttatactgaaagatggtccagagcgtgtcattctagccggaccgatgccagtgactgtggctagtgccgcccagaggagaggaagaattggaaggaaccaaaataaggaaggtgatcagtatatttacatgggacagcctctaaataatgatgaggaccacgcccattggacagaagcaaaaatgctccttgacaatataaacacaccagaagggatcatcccagccctctttgagccggaaagagaaaagagtgctgcaatagacggggagtacagactacggggtgaagcgaggaaaacgtttgtggagctcatgagaagaggagatctacctgtctggctatcttacaaagtcgcctcagaaggcttccaatactccgacagaaggtggtgctttgatggggaaaggaacaaccaggtgttggaggagaacatggacgtggagatctggacaaaagaaggagaaagaaagaaactgcgaccccgctggctggatgccagaacatactctgacccactggctctgcgcgaattcaaagagttcgcagcaggaagaagaagcgtctcaggtgacctaatattagaaatagggaaacttccacaacatctaacgcaaagggcccagaaggccttggataatctggttatgctgcacaactctgaacaaggaggaaaagcttatagacacgccatggaagaattgccagacaccatagagacaataatgctcctagctttgatagctgtgctgactggtggagtgacgctgttcttcctatcaggaagaggcttagggaaaacatccataggcctactctgcgtgacgtcctcaagtgcactgttatggatggccagtgtggagccccattggatagcggcctctattatactagagttctttctgatggtgttgcttattccagagccagatagacagcgcactccacaagacaaccagttagcatatgtggtgataggtttgctattcatgatattgacagtggcagccactgagatgggattattggaaaccacaaagaaagacctggggattggtcatgcagctgctgaaaaccaccaccacgccgcaatgctggacgtagacctacatccagcttcagcctggaccctctacgcagtggccacaacgattatcactcccatgatgagacacacaattgaaaacacaacggcaaatatttccctgacagccattgcaaaccaggcagctatattgatgggacttgataagggatggccaatatcaaagatggacataggagttccacttctcgccttggggtgctactctcaagtgaacccgctgacgctgacagcagcggtactgatgctagtagcccattatgccataattggaccaggactgcaagcaaaagccactagagaagctcaaaaaagaacagcggctggaataatgaaaaacccaactgtcgacgggatcgttgcaatagatttagaccctgtggtttatgatgcaaaatttgaaaaacagctaggccaaataatgttgttgatactttgcacatctcagattctcttgatgcggaccacatgggccttgtgtgaatccatcacactggccacaggacctctgaccacgctttgggagggatctccaggaaaattctggaacaccacgatagcggtgtccatggcaaacatttttaggggtagttatctagcaggagcgggtctggccttttcattaatgaaatctctgggaggaggtaggagagggacgggagcccaaggggaaacattgggagaaaagtggaaaagacagctgaaccaattgagcaagtcagaatttaaaacttacaagaggagtgggattatagaagtggatagatctgaagccaaggaggggttgaaaagaggagaaacaaccaaacacgcagtgtcgagaggaacggccaaactgaggtggtttgtggagaggaaccttgtgaaaccagaagggaaagtcatagacctcggttgtggaagaggtggctggtcatattattgcgctgggctgaagaaagtcacagaagtgaaaggatccacaaaaggaggacctggacatgaggaaccgatcccaatggcaacctatggatggaacctagtaaagctacactccggaaaagatgtattctttataccacctgagaaatgtgacactcttttgtgtgatattggtgagtcctctccgaacccgactatagaagaaggaagaacgttacgtgttctaaagatggtagaaccatggctcagaggaaaccaattttgcataaaaattctaaatccctatatgccgagtgtggtagaaactctggagcaaatgcaaagaaaacatggaggaatgttagtgcgaaatccactctcaagaaattccactcatgaaatgtactgggtttcatgtggaacaggaaacattgtgtcagcagtaaatatgacatctagaatgctgctaaaccggttcacaatggctcacaggaagccaacatatgaaagagatgtggacttgggcgctggaacgagacatgtggcagtagaaccagaggtggccaacctagacatcattggccagaggatagagaacataaaaaatgaacacaaatcaacatggcattatgatgaggataatccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgacaccacaccctttggacaacaaagggtgtttaaagagaaagttgatacgcgcacaccaaaagcgaaacgaggcacagcacaaatcatggaggtgacggccaagtggttatggggtttcctctctagaaacaaaaaacccagaatctgcacaagagaagagtttacaagaaaagttaggtcaaatgcagctattggagcagtgttcgttgatgaaaatcaatggaactcaccaaaagaagcagtggaagatgaacggttctgggaccttgtgcacagagagagggagcttcataaacaaggaaaatgtgccacgtgtgtctacaacatgatgggaaagagagagaaaaaattaggagagttcggaaaggcaaaaggaagtcgcgcaatatggtacatgtggttgggagcgcgcttcttagagtttgaagcccttggcttcatgaatgaagatcactggttcagcagagagaattcactcagtggagtggagggagaaggactccacaaacttggatacatactcagagatatatcaaagattccagggggaaatatgtatgcagatgacacagccggatgggacacaagaataacagaggatgatcttcagaatgaggccaaaatcactgacatcatggaacctgaacatgccctactggccacgtcaatctttaagctaacctaccaaaataaggttgtaagggtacagagaccagcaaaaaatggaaccgtgatggatgtcatatccaggcgtgaccagagaggaagtggacaggttggaacttatggcttaaacaccttcaccaacatggaggcccaactaataagacaaatggagtctgaaggaatctttttacccagcgaattggaacccccaaatttagccggaagagttcctgactggttggaaaaacatggcaccgagaggctgagaagaatggcaatcagtggagatgactgtgtggtgaaaccaattgatgacagatttgcaacagccttaacagccttgaatgacatgggaaaggtaagaaaagacataccgcagtgggaaccttcaaaaggatggaatgattggcaacaagtgcccttctgctcacaccacttccaccagctgattatgaaggatgggagggagatagtggtgccatgccgcaaccaagatgaacttgtgggtagggccagagtgtcacaaggcgccggatggagcttgagagaaactgcatgtctaggcaagtcgtatgcacaaatgtggcagctgatgtacttccacaggagagacttgagactagcggctaatgctatctgttcagccgttccagttgattgggtcccaaccagtcgcaccacctggtcgatccatgcccaccatcaatggatgacaacagaagacatgttgtcagtgtggaatagggtctggatagaggaaaacccatggatggaggataaaactcatgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattatctagactacatgacatcgatgaagagattcaaaaacgagagtgatcccgaaggggcactctggtaa

SEQ ID NO: 6342 - RNA, 9879 nt, synthetic construct
  misc_feature 1..9879: note = derived and/or modified CDS sequence (wt) from DENV-1__KU365900__SS-prME
  source 1..9879: mol_type = other RNA
tctgtgaccatgctccttatgctgatgcctacagccttggcattccatttgactacacgagggggagagccgcacatgatagtcagcaagcaggaaagaggaaagtcacttttgtttaagacctcagcaggtgtcaacatgtgcaccctcatagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgttgcactggccccacacgtgggacttggtttggaaacaagaaccgaaacgtggatgtcctccgaaggcgcttggaaacagatacaaagagtggagacttgggccctgagacacccaggattcacggtgatagccctttttctagcacatgccataggaacatccatcacccagaaagggattatcttcattttgttaatgctggttacaccatccatggccatgcgatgcgtgggaataggcagcagggacttcgtggaaggactgtcaggagcaacttgggtagatgtggtgttggaacatggaagttgcgtcactaccatggcaaaagacaaaccaacattggacattgaactcttgaagacggaagtcacaaaccctgctgtcctgcgcaaactgtgcattgaagctaaaatatcaaacaccaccaccgattcaagatgtccaacacaaggagaagccacactggtggaagaacaagacgcgaactttgtgtgtcgacgaacgtttgtggacagaggctggggcaatggctgtgggctctttggaaaaggaagccttataacgtgtgcaaagttcaagtgtgtgacaaaactggaaggaaaaatagtgcaatatgaaaacttgaaatattcagtaatagtcaccgtccacactggagaccagcaccaggtgggaaatgaaagcacagaacatgggacaactgcaaccataacacctcaagctcctacgacagaaatacagctgaccgactacggagctcttacattggattgttcacccagaacaggactggacttcaatgaaatggtgttgttgacaatgaaagaaaaatcatggctagtccacaaacaatggtttctagacctaccactgccttggacctcgggagcttcaacatcacaagaaacttggaacagacaagatttgctggtgacatttaagacagctcatgcaaagaagcaggaagtagtcgtactaggatcacaagaaggagcaatgcacactgcgttgaccggagcgacggaaatccaaacgtctggaacgacaacaatttttgcaggacacttgaagtgtagactaaagatggacaaactgactctaaaagggatgtcatatgtgatgtgcacgggctcattcaagctagagaaagaagtggctgagacccagcatggaacagttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagattttcggaactgcatatggagttttgttcagcggtgtttcctggaccatgaaaataggaataggggttctgctgacatggctaggattaaactcaaggagcacgtccctttcgatgacgtgcattgcagtcggcctagtaacgctatacttaggagtcatggttcaggcggattcaggatgtgtaattaattggaaaggtagagaactcaaatgtggaagtggcatttttgtcactaatgaagttcacacttggacagagcaatacaaatttcaagctgattccccaaagagactatcagcagccattgggaaggcatgggaggagggtgtgtgtggaattcgatcagcaactcgtctcgagaacatcatgtggaagcaaatatcaaatgaattgaaccacatcttgcttgaaaatgacatgaaattcacagtggttgtaggagatgttgctgggatcctggctcaaggaaaaaaaatgattaggccacaacccatggaacacaaatactcgtggaaaagctggggaaaagctaaaatcataggggcagatgtacagaacaccacctttatcatcgacggcccaaacaccccagaatgccctgatgatcaaagagcatggaacatttgggaagttgaggattatggatttggaattttcacgacaaacatatggctgaaattgcgtgactcctacacccaagtgtgtgaccaccggctaatgtcagctgccatcaaagacagcaaggcagttcacgctgacatggggtactggatagaaagtgaaaagaacgagacctggaagctggcaagagcctctttcatagaagtcaaaacgtgtatctggccaaaatctcacactctatggagcaatggagttctggaaagtgaaatgataattccaaagatctatggaggaccaatatctcagcacaactacagaccaggatatttcacacaaacggcagggccgtggcatctaggcaagttggaactggattttgatttgtgtgagggtaccacggttgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggccaggggaagtggacagcttttcactaggactgttatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacaggatggggatgggaacgacctacctagctctgatggccacttttaaaatgagaccaatgtttgccgtagggctactactccgcagactaacatccagagaagttcttcttctaacaattggactgagtctagtggcatctgtggagttaccaaattccttggaggagctgggggatggacttgcaatgggcattatgatcttaaaattattgactgattttcaatcacatcagctgtgggctaccttgctgtccttgacatttatcaaaacaacgttttccttgcactatgcatggaagacaatggctatggtactgtcaattgtatctctcttccccttatgcctgtccacgacctcccaaaaaacaacatggcttccggtgctgttgggatctcttggatgcaaaccactaaccatgtttcttatagcagaaaacaaaatctggggaagaaaaagttggcccctcaatgaaggaatcatggctgttggaatagtcagcatcctactaagttcactcctcaaaaatgatgtgccgctagctgggccattgatagctggaggcatgctaatagcatgttatgtcatatctggaagctcagccgatctatcactagagaaagcggctgaggtctcctgggaagaagaagcagaacactctggtgcctcacacaacatattagtggaggtccaagatgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccagaagtggaaagagcagttcttgatgatggcatctatagaatcatgcagagaggactgttgggcaggtcccaagtgggggtaggagtgtttcaagaaaacgtgttccacacaatgtggcatgtcaccaggggagctgtactcatgtaccaagggaagagactggaaccgagctgggccagtgtcaaaaaagacctgatctcatatggaggaggttggaggcttcaaggatcctggaacacgggagaagaagtgcaggtgattgctgttgaaccagggaaaaatcccaaaaatgtacaaacagcgccgggcacctttaagacccctgaaggcgaagttggagccattgccctagattttaaacccggcacatctggatctcccatcgtgaacagagaagggaaaatagtaggtctttatggaaatggagtggtgacaacaagtggaacctacgtcagtgccatagctcaagccaaagcatcacaagaagggcccctaccagagattgaagatgaggtgtttaggaaaagaaacttaacaataatggacctacatccaggatcgggaaaaacaagaagataccttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattattatggatgaagcacatttcaccgatccatccagcatagcggctagagggtacatctcaacccgagtgggcatgggtgaagcagctgcgatcttcatgacagccactcccccaggatcagtggaggcctttccacagagcaacgcagttatccaagatgaggaaagagatattcctgagagatcatggaactcaggttatgagtggatcactgacttcccaggcaaaacagtttggtttgttccaagcattaaatcaggaaatgatattgccaactgcttaagaaagaatgggaaacgggtgattcaattgagcagaaaaacctttgacacagagtaccaaaaaacaaaaaataacgactgggactacgtcgtcacaacagacatctccgaaatgggagcaaatttccgggccgacagggtgatagacccaagacggtgtctaaaaccggtaatactaaaagatggtccagagcgtgtcattttagcaggaccgatgccagtgactgtggccagtgccgcccagaggagaggaagaattggaaggaaccacaacaaggaaggtgatcagtacatctatatgggacagcctttaaacaacgatgaagatcacgctcactggacggaagcaaaaatgctccttgataatataaacacaccagaaggaattatcccagccctcttcgagccggagagagaaaagagtgcggcaatagacggggaatacagactgcggggtgaagcaaggaaaacgtttgtggagctcatgagaagaggagatctacctgtctggctatcctacaaagttgcctcagaaggcttccagtactctgacagaaaatggtgctttgacggggaaaggaacaaccaggtgttggaagagaacatggacgtggagatctggacaaaagaaggagaaagaaagaaactacgaccccgctggctggatgccagaacatactcagacccactggccctgcgcgagtttaaagagtttgcagcaggaagaagaagcgtctcaggtgatctaatattggaaatagggaaacttccacaacacttgacgcaaagggcccagaatgccttggacaacctggttatgttgcacaactccgaacaaggaggaagagcctatagacatgcaatggaagaactgccagacaccatagaaacgttaatgctcctagctttgatagctgtgttaactggtggagtgacgctgttcttcctatcaggaaggggtttagggaaaacatctatcggcctactctgcgtgatggcttcaagcgtattgctatggatggccagtgtagagccccattggatagcggcctccatcatactggagttcttcctgatggtgctgctcattccagagccagacagacaacgcactccgcaggacaatcagctggcatatgtggtgataggtttgttattcatgatactgacagtagcagccaatgagatgggactgctggaaaccacaaagaaagacttagggattggccacgtggctgttgaaaatcaccaccatgccacaatgctggacgtagacttacatccagcttcagcctggaccctctatgcagtggccacaacaatcattactcccatgatgaggcacacaatcgaaaacacaacggcaaacatttccctgacagccattgcaaatcaggcagctatattgatgggacttgacaaaggatggccaatatcgaagatggatataggagttccacttctcgccttggggtgctattcccaagtgaatccactgacgctgacagcggcggtattgatgctagtggcccattacgctataattggacctggactgcaagcaaaagctactagagaagctcaaaaaaggacagcggccggaataatgaaaaatccaactgttgatggaatcgttgcaatagatttggaccctgtggtttatgatgcgaaatttgagaaacaactaggccaaataatgttgttgatactatgcacatcacagatcctcttgatgcggaccacatgggccttgtgcgaatccatcacactggccactggacctctgaccacgctctgggagggatctccaggaaaattttggaacaccacgatagcagtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaattcaacacctataaaaggagtgggatcatggaagtggacagatccgaagccaaagagggactgaaaagaggagaaacaaccaaacatgcagtgtcgagaggaaccgctaaattgaggtggtttgtggagaggaaccttgtgaaaccagaagggaaagtcatagacctcggttgtggaagaggtggctggtcatactattgcgctgggctgaagaaagtcacagaggtgaagggatacacaaaaggaggacctggacacgaagaaccaatcccaatggcgacctatggatggaacctagtaaagctgtactccgggaaagacgtattctttataccacctgagaaatgtgacaccctcttgtgtgatattggtgagtcctctccaaacccaactatagaggaaggaagaacgctacgcgtcctaaagatggtggaaccatggctcagaggaaaccaattttgcataaaaattttgaatccctacatgccaagtgtggtggaaactctggagcaaatgcaaagaaaacatggaggaatgctagtgcgaaatccactttcaagaaattctactcacgaaatgtactgggtttcatgtggaacaggaaacattgtgtcagcagtaaacatgacatccagaatgttgctaaatcgattcacaatggctcataggaaaccaacatatgaaaaagacgtggacctaggcgccggaacaagacatgtggcagtagaaccagaggtagctaacctagatatcattggccagaggatagagaacataaaacatgaacacaagtcaacatggcattatgatgaggacaatccatataaaacatgggcctatcatggatcatatgaggtcaaaccatcaggatcagcctcatccatggtcaatggtgtggtgaaactgctcaccaaaccatgggatgtcatccccatggtcacacaaatagccatgactgacactacaccctttggacaacagagggtatttaaagagaaagttgacacacgcacaccaaaagcaaaacgaggcacagcacaaatcatggaggtgacagccaggtggttatggggttttctttctaggaacaagaagccaagaatttgtacaagagaggagttcacaagaaaagttaggtcaaacgcagccatcggagcagtgttcattgacgaaaatcaatggaactcagcaaaagaagcagtggaagatgagcggttttgggaccttgtgcacagagagagggagcttcacaaacagggaaaatgtgccacgtgtgtttacaacatgatggggaagagagagaaaaagctaggagaatttggaaaggcaaaaggaagtcgtgcaatatggtacatgtggttgggagcacgctttctagagttcgaagctcttggtttcatgaacgaagaccactggttcagcagagagaattcactcagcggagtggaaggagaaggactccacaaacttggatatatactcagagacatatcaaagatttcagggggaaacatgtacgctgatgacacagccggatgggatacaaggataacagaggatgaccttcagaatgaggccaaaattactgacatcatggaacccgaacatgccctactggctaaggcaatcttcaagctaacctaccaaaataaagtggtaagggtacagagaccagcaaaaaatggaaccgtgatggatgtcatatccagacgtgaccagagaggaagtggccaggtcggaacttatggcttaaacactttcaccaacatggaagcccagctgataagacaaatggagtctgagggaatcttttcacccagtgaattagagaccccaaatttagccgagagagttctcgactggttgggaaaatatggcgtcgaaaggctaaaaagaatggcaatcagtggagatgactgcgtagtgaaaccaattgatgataggtttgcaacagccttaacagctctgaatgatatgggaaaagtaagaaaagatataccacaatgggaaccctcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaaccgcatgcctaggcaaatcatatgcacaaatgtggcagctgatgtacttccacaggagagacctgagactagctgctaatgctatctgttcagccgttccagttgattgggtcccaactagccgcaccacctggtctatccatgcccatcaccaatggatgacaacagaagacatgctgtcagtgtggaatagagtttggatagaggaaaacccatggatggaggacaaaacccatatatccagttgggaagatgttccatatttagggaaaagggaagatcaatggtgtggatccctgataggcttaacagcaagggccacctgggccaccaacatacaagtggccataaaccaagtgagaagactaattgggaatgagaactatctagattacatgacatcaatgaagagattcaagaacgagagtgatcccgaaggggcactctggtga

SEQ ID NO: 6343 - RNA, 9879 nt, synthetic construct
  misc_feature 1..9879: note = derived and/or modified CDS sequence (wt) from DENV-1__FJ176779__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcacttttgttcaagacctcagcaggtgtcaacatgtgcacccttgtagcgatggatttgggagagttatgtgaggacacaatgacttacaaatgccctcgaatcactgaggcggaaccagatgacgttgattgttggtgcaatgccacagacacatgggtgacctatggaacatgttcccaaactggcgagcaccgacgagacaaacgttccgtcgcactggccccacacgtgggacttggtttggaaacaagaactgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacactggacattgaactcttgaagacggaagtcacaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgctaagttcaagtgtgtgacaaaactggaaggaaagatagttcaatatgaaaacttgaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagactttaatgaaatggtgttgttgacaatgaaagaaaaatcatggctagtccacaaacaatggtttctagacttaccactgccttggacctcgggagcttcaacatcacaagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatgggagattgataacagccaaccccatagtcactgacaaagaaaaaccagtcaacattgaggcagaaccgccttttggtgagagttacatcgtgataggagtaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagagaactcaaatgtggaagtggcatttttgtcaccaatgaagttcacacttggacagagcaatacaaatttcaagctgactccccaaaaagactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatttgggaagttgaggactatggatttggaattttcacgacaaacatatggctgaaattgcgtgactcctacacccaagtgtgtgaccaccggctaatgtcagcagccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttaggaccacaacagtcacaggaaagataattcatgaatggtgttgcagatcttgtacgctaccacccttacgtttcagaggagaagatgggtgctggtacggtatggaaatcagaccagtcaaggaaaaggaagagaatctagtcaaatcaatggtctctgcagggtcaggggaagtggacagcttttcactgggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcaatcacatcagttgtgggctaccttgctgtccatgacatttatcaaaacaacgttttccttgcactatgcatggaagacaatggctatggtactgtcaattgtatctctcttccccttatgcctgtccacgacctcccagaaaacaacatggcttccggtgctattgggatctcttggatgcaaaccactaaccatgtttcttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtacttttggcagaaaaagaaacagagatctggagtgttatgggacacacctagccctccaaaagtggaaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcggggaaaacaagaagatatcttccagccatagtccgtgaggccataaaaaggaagatgcgcacactaattctggctcccacaagggttgtcgcttccgaaatggcagaagcactcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgaattcccaggtaaaacagtctggtttgttccaagcattaaagcaggaaatgacattgccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatagacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaagttgcctcagaaggcttccagtactctgacagaagatggtgctttgacggggaaaggaacaaccaggtgttggaggagaacatggacgtggagatttggacaaaagaaggagaaagaaagaagctacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagctgtgttaactggtggagtgacgctgttcttcctatcaggaaagggcctagggaaaacatctatcggcctactctgcgtgatggcttcaagcgtactgctatggatggccagtgtggagccccattggatagcggcctccatcatattggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtaaccaacctagatatcattggccagaggatagagaacataaaatatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggtcacacaaatagccatgactgacactacaccctttggacaacagagggtgtttaaagagaaagttgacacacgcacaccaaaagcaaaacgaggcacagcacaaatcatggaagtgacagccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagaggatgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggtttgcgacagccttaacagctctgaatgatatgggaaaagtaaggaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattgggttccaactagccgcaccacttggtcgatccatgcccatcaccaatggatgacaacagaagacatgctgtcagtatggaatagggtttggatagaggaaaacccatggatggaggacaaaacccgtatatccagttgggaagatgttccatacctagggaaaagggaagatcaatggtgtggatctctgataggcttaacagcaagggccacctgggccaccaacatacaagtggccataaaccaagtgagaagactaattgggaatgagaattattcggattacatgacatcaatgaagagattcaagaacgagagtgaacccgaaggggcactctggtga

SEQ ID NO: 6344 - RNA, 9879 nt, synthetic construct
  misc_feature 1..9879: note = derived and/or modified CDS sequence (wt) from DENV-1__FJ176780__SS-prME
  source 1..9879: mol_type = other RNA
tctgtgaccatgctccttatgctgatgcctacagccttggcgttccatttgactacacgagggggagagccgcacatgatagtcagcaagcaggaaagaggaaagtcactcttgttcaagacctcagcaggtgtcaacatgtgcacccttatagcgatggatttgggagagttatgtgaggacacaatgacttacaaatgccctcgaatcactgaagctgaaccagatgacgttgattgttggtgtaatgccacagacacatgggtgacctatggaacatgctcccaaactggcgagcaccgacgagacaaacgttccgtcgcactggccccacacgtgggacttggtttggaaacaagaaccgaaacgtggatgtcctctgaaggcgcttggaaacagatacaaagagtggagacttgggccctgagacacccaggattcacggtgatagccctttttctagcacatgccataggaacatccatcacccagaaagggattattttcattttgttaatgctggtaacaccatccatggccatgcgatgcgtgggaataggcagcagggacttcgtggaaggactgtcaggagcaacttgggtagatgtggtactggaacatggaagttgcgtcaccaccatggcaaaagacaaaccaacattggacattgaactcttgaagacggaagtcacaaaccctgccgtcctgcgcaaactgtgcattgaagctaaaatatcaaacaccaccaccgactcaagatgtccaacacaaggagaagccacactggtggaagaacaagacgcgaactttgtgtgtcgacgaacgttcgtggacagaggctggggcaatggctgtgggctcttcggaaaaggaagcctaataacgtgtgctaagttcaagtgtgtgacaaaactggaaggaaagatagttcaatatgaaaacttgaaatattcagtaatagtcaccgttcacaccggagaccagcaccaagtgggaaatgaaagcacagaacatgggacaactgcaactataacacctcaagctcccacgacggaaatacagctgaccgactacggagctcttacattggattgttcacctagaacaggactagactttaatgaaatggtgttgttgacaatgaaagaaaaatcatggctagtccacaaacaatggtttttagacctaccactgccttggacctcgggagcttcaacatcacaagagacttggaacagacaagatttgctggtgacattcaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgcagactaaagatggacaaactgactctaaaagggatgtcatatgtgatgtgcacaggctcattcaagctagagaaagaagtggctgagacacagcatggaaccgttctagtgcagattaaatacgaaggaacagatgcaccatgcaagatccctttttcgacccaagatgaaaaaggagtaacccagaatgggagattgataacagctaaccccatagttactgacaaagaaaaaccagtcaacattgaggcagaaccgccttttggtgagagctacattgtaataggggcaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggctaggattaaactcaaggagcacgtccctttcgatgacgtgcattgcagttggcctagtaacactatacctaggagtcatggttcaggcggattcaggatgtgtaattaattggaaaggtagagaactcaaatgtggaagtggcatttttgtcaccaatgaagttcatacttggacagagcaatacaaatttcaagctgactccccaaagagactatcagcagccatcgggaaggcatgggaggagggtgtgtgtggaattcgatcagcaactcgtctcgagaacatcatgtggaagcaaatatcaaatgaactgaatcacatcttacttgaaaatgatatgaaattcacagtggttgtaggagatgttgctgggatcttggctcaaggaaagaaaatgattaggccacaacccatggaatacaaatactcgtggaaaagctggggaaaggctaaaatcataggggcagatgtacagaacaccaccttcatcatcgatggcccaaacaccccagaatgccctgatgaccaaagagcatggaacatttgggaagttgaggactatggatttggaattttcacgacaaacatatggctgaaattgcgtgattcctacacccaagtgtgtgaccaccggctaatgtcagctgccatcaaggacagcaaggcagttcacgctgacatggggtactggatagaaagtgaaaagaacgagacctggaagctggcaagagcctctttcatagaagttaaaacatgtatctggccaaaatcccacactctatggagcaatggagttctggaaagcgaaatgataattccaaagatctatggaggaccaatatctcagcacaactacagaccaggatatttcacacaaacagcagggccgtggcacttaggcaagttggaactggattttgatttgtgtgagggtaccacagttgttgtggatgaacattgtggaaatcgaggaccatctcttaggaccacaacagtcacaggaaagataattcatgaatggtgttgcagatcttgcacgctaccacccttacgtttcagaggagaagacgggtgctggtacggtatggaaatcagaccagtcaaggaaaaggaagaaaatctagtcaaatcaatggtctctgcagggtcaggggaagtggacagcttttcactaggactgctatgcatatcaataatgatcgaagaggtgatgagatccagatggagtagaaaaatgctgatgactggaacactggctgtgttcttccttctcataatgggacaattgacatggaacgatctgatcagattatgcatcatggttggagccaacgcttccgacaggatggggatgggaacgacgtacctagctctgatggccacttttaaaatgagaccgatgtttgctgtagggctattatttcgcagactaacatccagagaagttcttcttctaacaattggattgagtctagtggcatctgtggagttaccaacttccttggaggagctgggggatggacttgcaatgggcattatgattttaaaattattgactgactttcaatcacatcagttgtgggctaccttgctgtccttgacatttgtcaaaacaacgttttccttgcactatgcatggaagacaatggctatggtactgtcaattgtatctctcttccccttatgcctgtccacgacctcccaaaaaacaacatggcttccggtgctattgggatcccttggatgcaaaccactaaccatgtttctcatagcagaaaacaaaatctggggaaggagaagttggcccctcaatgaaggaatcatggctgttggaatagtcagcatcctactaagttcactcctcaaaaatgatgtgccgctagctgggccactaatagctggaggcatgctaatagcatgttatgttatatctggaagctcagccgacctatcactagagaaagcggctgaggtctcctgggaagaagaagcagaacactctggtgcctcacacaacatattagtggaggtccaagatgatggaaccatgaagataaaggatgaagagagagatgacacgctaaccattcttcttaaagcaactctgctagcagtttcaggggtgtacccattatcaataccagcgacccttttcgtgtggtacttttggcagaaaaagaaacagagatctggagtgttatgggacacacccagccctccagaagtggaaagagcagttcttgatgatggcatctatagaattatgcagagaggactgttgggcaggtcccaagtaggggtaggagttttccaagaaaacgtgttccacacaatgtggcatgtcaccaggggagctgtactcatgtatcaagggaagagactggaaccgagctgggccagtgtcaaaaaagacctgatctcatatggaggaggttggaggcttcaaggatcctggaacacaggagaagaagtgcaggtgattgctgttgaaccagggaaaaaccccaaaaatgtacaaacagcgccgggcacctttaagacccctgaaggtgaagttggagccattgccctagactttaaacctggcacatctggatctcccatcgtaaacagagaaggaaaaatagtaggtctttatggaaatggagtagtgacaacaagtggaacctacgtcagtgccatagctcaagccaaagcatcacaagaagggcccctaccagagattgaagacgaggtgtttaggaaaagaaacttaacaataatggacctacatccaggatcggggaaaacaagaagatatcttccagccatagtccgtgaggccataaaaaggaagctgcgcacactaattctggctcccacaagggttgtcgcttccgaaatggcagaggcgctcaagggaatgccaataaggtaccaaacaacagcagtgaagagtgaacacacaggaaaagagatagttgaccttatgtgtcacgccactttcactatgcgcctcctgtctcccgtaagagttcccaattacaacatgatcatcatggatgaagcacatttcaccgatccatccagtatagcggccagagggtacatctcaacccgagtgggcatgggtgaagcagctgcaatcttcatgacagccactcccccaggatcagtggaggcctttccacagagcaacgcagttatccaagatgaggaaagagacattcctgagagatcatggaactcaggctatgagtggatcactgacttcccaggtaaaacagtttggtttgttccaagcattaaatcaggaaatgacattgccaactgcttaagaaagaatgggaaacgggtgattcaattgagcaggaaaacctttgatacagagtaccaaaaaacaaaaaacaacgactgggactacgtcgtcacaacagacatctccgaaatgggagcaaatttccgagccgacagggtgatagacccaagacggtgtctgaaaccggtaatactaaaagatggtccagagcgtgtcattttagcaggaccaatgccagtgactgtggccagtgccgcccagaggagaggaagaattggaaggaaccacaataaggaaggtgatcagtacatctacatgggacagcctttaaacaacgatgaagatcacgctcactggacagaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcctacaaggttgcctcagaaggctaccagtactctgacagaagatggtgctttgacggagaaaggaacaaccaggtgttggaggagaacatggacgtggagatctggacaaaagaaggagaaagaaagaaactacgaccccgctggctggatgccagaacatactcagacccactagccctgcgcgagtttaaagagtttgcagcagggagaagaagcgtctcaggtgatctaatattagaaatagggaagcttccacaacacttgacgcaaagggcccagaatgccttggacaacctggttatgttgcacaactccgaacaaggaggaagagcctatagacatgcaatggaagaactgccagacaccatagaaacgttgatgctcctagctttgatagctgtgttaactggtggagtgacattgttcttcctatcaggaaggggcctagggaaaacatctattggcctactctgcgtaatggcttcaagcgtactgctatggatggccagtgtggagccccattggatagcggcctccatcatactggagttcttcctgatggtgctgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcactcccatgatgaggcacacaatcgaaaacacaacggcaaatatttccctgacagccattgcaaaccaggcagctatattgatgggacttgacaaaggatggccaatatcgaagatggacataggagttccacttctcgccttggggtgctattcccaggtgaatccactgacgctgacagcggcggtattgatgctagtggctcattacgccataattggacctggactgcaagcaaaagctactagagaagctcaaaaaaggacagcggccggaataatgaaaaatccaaccgttgatggaattgttgcaatagatttggaccctgtggtttatgatgcaaaatttgagaaacaactaggccaaataatgttgttgatactatgcacatcacagatcctcttgatgcggactacatgggccttgtgcgaatccatcacactggccactggacctctgaccacgctttgggagggatctccaggaaaattttggaacaccacgatagcggtttccatggcaaacattttcagaggaagttatctagcaggagcaggtctggccttctcattaatgaaatctctaggaggaggtaggagaggcacgggagcccaaggggaaacactgggagagaaatggaaaagacagctgaaccaactgagcaagtcagaatttaacacctataaaaggagtgggattatggaagtggacagatccgaagccaaggagggattgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaagctgcactctggaaaagacgtattctttataccacctgagaaatgtgacacccttttgtgtgatattggtgagtcctctccaaacccaactatagaggaaggaagaacgctacgcgtcctaaagatggtggaaccatggctcagaggaaaccagttttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacaggaaacattgtgtcagcagtaaacatgacatctagaatgttgctaaatcgattcacaatggctcacaggaaaccaacatatgaaagagacgtggacctaggcgccggaacaagacatgtggcagtggaaccagaggtaaccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgtcatccccatggttacacaaatagccatgactgacactacaccctttggacaacagagggtgtttaaagagaaagttgacacacgcacaccaaaagcaaaacggggcacagcacaaatcatggaggtgacagccaagtggttatggggttttctttctagaaacaagaaaccaagaatttgcacaagagaggagttcacaagaaaagttaggtcaaacgcagccattggagcagtgttcgttgatgaaaatcaatggaactcagcaaaagaagcagtggaagatgagcggttttgggaccttgtgcatagagagagggagcttcacaaacagggaaaatgtgccacgtgtgtttacaacatgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggactccacaaacttggatatatactcagagacatatcaaagattccagggggaaacatgtatgcagatgacacagccggatgggacacaaggataacagaggatgaccttcagaatgaggccagaattactgacatcatggaacccgaacatgccctactggctaagtcaatcttcaagttaacctaccaaaataaggtggtaagggtacagagaccagcaaaaaatggaaccgtgatggatgtcatatccagacgtgaccagagaggaagtggtcaggtcggaacttatggcttgaacactttcaccaacatggaagcccagctgataagacaaatggagtctgagggaatcttttcacccagcgaattagagaccccaaatttagccgagagagttctcgactggctggaaaaatatggcgtcgaaaggctgaaaagaatggcaatcagcggagatgactgcgtagtgaaaccaattgatgataggtttgcaacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgtaaccaagatgaacttgtgggtagggctagagtatcacaaggtgctggatggagcctgagagaaactgcatgcctaggcaagtcatatgcacaaatgtggcagctgatgtacttccacaggagagacctgagactagccgctaatgctatctgttcagccgttccagttgattggatcccaaccagccgtaccacctggtcgatccatgcccatcatcaatggatgacaacagaagacatgctgtcagtgtggaatagggtttggatagaggaaaacccatggatggaggacaaaacccacatatccagttggggagatgttccatatttaggaaaaagggaagaccaatggtgtggatccctgataggcttaacagcaagggccacctgggccaccaacatacaagtggccatataccaagtgagaagactaattgggaatgagaattatctagattacatgacatcaatgaagagattcaagaacgagagtgatcccgaaggggcactctggtga

SEQ ID NO: 6345 - RNA, 9879 nt, synthetic construct
  misc_feature 1..9879: note = derived and/or modified CDS sequence (wt) from DENV-1__JN205310__SS-prME
  source 1..9879: mol_type = other RNA
tctgtgaccgtgctcttcatgctgctgcccacagccctggcgttccatctgaccaccctagggggagagccgcacatgatagtcagcaagcaggaaagaggaaagtcacttttgtttaagacctctgcaggtgtcaacatgtgtacccttattgcaatggatttgggagagttgtgtgaggacacaatgacctacaaatgcccccggatcactgaaacggaaccagatgacgttgactgttggtgcaacgccacggagacatgggtgacttatggaacatgttctcaaactggtgaacaccgacgagacaaacgttctgttgcactggcaccacacgtagggcttggtctagaaacaagaaccgaaacgtggatgtcctctgaaggcgcttggaaacaaatacaaaaagtggagacctgggctctgagacacccaggattcacggtgatagctctttttctagcacatgccataggaacatccattacccagaaaggaattattttcattttgctgatgctggtaactccatccatggccatgcggtgcgtgggaataggcaacagagacttcgtggaaggaccgtcaggagctacgtgggtggatgtggtactggagcatggaagttgcgtcactacaatggcaaaaaacaaaccgacactggatattgaactcttaaagacggaggtcacaaacccagccatcctgcgcaaactgtgcattgaagccaaaatatcaaatactaccaccgattcgagatgtccaacacaaggagaagccacgctggtggaagaacaagacacgaactttgtgtgtcgacgaacgttcgtggacagaggctggggcaatggttgtgggctatttggaaaaggtagcttaataacgtgtgctaagtttaagtgtgtgacaaaattggaaggaaagatagtccaatatgaaaatttaaaatattcagtgatagtcaccgtccacactggagaccagcaccaagttgggaatgagactacagaacatggaacaactgcaatcataacacctcaagctcctacgtcggaaatacagctgacagactacggagctctaacaccggactgttcacctagaacagggctagacttcaatgagatggtgttgttgacaatgaaagaaaaatcatggctcgtccacaaacaatggtttctagacttaccgctgccttggacctcgggggcttcaacatcccaagagacttggaatagacaagacttgctggtcacatttaagacagctcatgcaaagaagcaggaagtagttgtactaggatcacaagaaggagcgatgcacactgcgctgactggagcaacagaaatccaaacgtctggaacgacaacaattttcgcaggacacctgaaatgcagactgaaaatggataaactgactttaaaaggggtatcatatgtaatgtgcacaggctcattcaagctagaaaaggaagtggctgagacccagcatggaactgttctagtgcaggttaagtacgaaggaacagatgcaccatgtaagatcccctcctcatcccaagatgagaagggagtgatccagaatgggagattgataacggccaaccccatagtcactgacaaagaaaaaccagtcaacattgaggcggagccaccttttggtgagagctacatcgtggtaggagcaggtgagaaagctttgaaactaagctggttcaagaagggaagcagtatagggaaaatgtttgaagcaactgcccgtggagcacgaaggatggccattctgggagacactgcatgggacttcggttctataggaggagtgttcacgtccgtgggaaaactggtacaccagatttttggaactgcgtacggagttttgttcagcggtgtttcttggaccatgaaaataggaatagggattctgttgacatggctaggattaaattcaaggagcacgtccctttcaatgacgtgtatcgcagttggcatggttacactgtacctaggagtcatggttcaggcggactcgggatgtgtaattaactggaaaggcagagaactcaaatgtggaagcggcatttttgtcactaatgaagttcacacctggacagagcaatacaaattccaggccgactccccaaagagactatcagcagccatagggaaggcatgggaggagggtgtgtgtggaattcgatcagccactcgtctcgagaacatcatgtggaagcaaatatcaaatgaattaaaccacatcttacttgaaaatgacatgaaattcacagtggtcgtaggagatgtcagtgggatcttggcccaaggaaagaaaatgattaggccacaacccatggaacacaaatactcgtggaaaagctggggaaaagccaagatcataggagcagatgtacagaacaccaccttcatcatcgacggcccaaacaccccagaatgccctgataaccaaagagcatggaacatctgggaagttgaagactatggatttggaattttcacgacaaacatatggttgaaattgcgtgactcttttactcaagtgtgtgaccaccggctaatgtcagctgccattaaggatagcaaagcagtccatgctgacatggggtactggatagaaagtgaaaagaaagagacttggaagttggcaagagcctccttcatagaagttaagacatgcatctggccaaaatcccacactctatggagcaatggagtcctggaaagtgagatgataatcccaaagatatatggaggaccagtatctcagcacaactacagaccaggatatttcacacaaacagcagggccatggcacttaggcaagttggaactagattttgatttgtgtgaaggtaccacagttgttgtggatgaaaattgtggaaatcgaggaccatctcttagaactacaacagtcacaggaaagacaacccatgaaaggtgctgtagatcttgcacgttaccccctctacgtttcaaaagggaagacgggtgctggtacggcatggaaatcagaccagtcaaggagaaggaagagaacctagttaagtcaatggtttctgcagggtcaggagaagtggatagtttttcactaggactgctatgcatatcaataatgatcgaagaggtaatgagatccagatggagcagaaagatgctgatgactggaacattggctgtgttcctccttctcacaatgggacaatcgacatggaatgatctgatcaggctatgtaccatggttggagccaatgcttcagacatgatggggatgggaacaacgtacctagctttgatggccactttcagaatgagaccaatgttcgcagtcggactcttatttcgcagattaacatctagagaaattcttcttcttacagttggattgagcctggtggcatctgtagaactaccaaattccttagaagagctaggggatggacttgcaatgggcatcatgatgttgaaattactgactgattttcagccacatcagctatgggctaccttgctgtctttaacatttgtcaaaacaactctgtcattgcactatgcatggaagacaatggccatgatactatcaattgtgtctctcctccctttgtgcctgtccacgacatctcaaaaaacgacatggcttccggtgctgctgggatctcttggatgcaaaccactaaccatgtttcttataacagaaaacaaaatttgggggaggagaagttggcccctcaatgaaggaattatggctattggaatagtaagcatcctactaagttcacctctcaaaaatgatgtgccactagctggcccactaatagctggaggcatgctaatagcatgttatgtcatatctggaagctcagccgacttatcactggagaaagcggctgaggtttcctgggaagatgaagcagaacactctggtgcctcacacaacatactagtggaggtccaagatgacggaaccatgaagataaaagatgaagagagagatgacacactcaccattctcctcaaagctactctgttagtaatctcaggggtatacccaatgtcaataccggcgactctctttgtgtggtatttttggcagaaaaagaaacagagatcaggagtgctatgggacacacccagccctccagaagtggaaagagcagtccttgacaatggcatttatagaattctccaaagaggattgttgggcaggtctcaagtaggagtaggagtttttcaagaaggtgtgttccacacaatgtggcacgtcaccaggggagctgttctcatgtaccaagggaagagattggaaccaagttgggctagtgtcaaaaaagacttgatctcatatggaggaggttggaggtttcaaggatcctggaacacgggagaagaagtgcaggtgattgctgttgaaccggggaagaaccccaaaaatgtacagacaacgccaggcaccttcaagacccctgaaggtgaagttggagctatagctctagacttcaagcccggcacatctggatctactatcgtgaacagagagggaaaaatagtgggtctttatggaaatggagtggtgacaacaagtggaacctacgtcagtgccatagctcaagctaaagcatcacaagaagggcccctaccagagattgaggacgaggtgtttaggaaaaggaatttaacaataatggacctacatccaggatcagggaaaacgagaagataccttccagccatagtccgtgaggccataaaaagaaagctgcgcacgctagtcttggcccccacaagagttgtcgcttctgaaatggcagaagcgcttaagggaatgccaataaggtatcagacaacagcagtgaaaagtgaacacacgggaaaggagatagttgatcttatgtgtcacgccactttcactatgcgtctcctgtctcctgtgagagtccccaattataacatgattatcatggatgaagcacatttcaccgatccagccagcatagcagccagagggtacatctcaacccgagtaggtatgggtgaagcagctgcgatcttcatgacagccactccccccggatcggtggaggcctttccacagagcaatgcagttatccaagatgaggaaagagacattcctgaaagatcatggaactcaggctatgaatggatcactgatttcccaggtaaaacagtctggtttgttccaagcatcaaatcaggaaatgacattgccaactgtttaagaaagaatgggaaacgggtggtccaattgagcagaaaaacttttgacactgagtaccagaaaacaaaaaataacgactgggactatgttgtcacaacagacatatccgaaatgggagcaaacttccgagccgacagggtaatagacccaaggcggtgcctgaaaccggtaatactaaaagatggtccagagcgtgtcatcctagccggaccgatgccagtgactgtggctagtgccgcccagaggagaggaagaattggaaggaacccaaataaggaaggtgatcagtacgtgtacatgggacagcctctaaacaatgatgaggaccacgcccattggacagaagcaaaaatgctccttgacaacataaacacaccagaagggatcattccagccctctttgagccggagagagaaaagagtgcagcaatagacggggaatacagattacggggtgaagcgaggaaaacgttcgtggaactcatgagaagaggagatctacctgtctggctatcctacaaagttgcctcagaaggcttccagtactctgacagaagatggtgctttgatggggaaaggaacaaccaggtgttggaggagaacatggacgtggagatttggacaaaagaaggagaaagaaagaaactacgaccccgctggctggatgccagaacatattctgacccactggctctgcgcgaattcaaagagttcgcagcaggaagaagaagtgtctcaggtgacctaatattagaaatagggaaacttccacaacatttaacgctaaaagctcagaatgctttggataatctggtcatgctgcacaactctgaacaaggaggtaaagcctacagacacgccatggaagaactaccagataccatagaaacgttaatgctcctagctctgatagctgtgttgactggtggagtgacgctgttcttcctatcaggaagaggtctaggaaaaacatccattggcctactctgtgtgatggcctcaagtgtactgttgtggatggccagtgtggagcctcattggatagcggcctctatcatactggagttctttctgatggtgttgcttattccagagccagaccgacagcgcactccacaagacaaccagctagcatatgtggtgataggtttgttattcatgatattgacagtggcagccaatgagatgggattgttggaaaccacaaagaaagacctggggattggtcatgcagctgctgaaaaccaccaccatgctgcaatgctggacgtggacctacatccagcttcagcctggactctctatgcagtggccacaacaatcatcactcccatgatgagacacacaattgaaaacacaacggcaaatatttccctgacagctatcgcaaaccacgcagctatattgatgggacttgacaagggatggccaatatcaaagatggacataggagttccacttctcgccttggggtgctattctcaggtgaacccgctgacgctgacagcggcggtattgatgctagtggctcactatgccataattggacctggactgcaggcaaaagctactagagaagctcaaaaaaggacagcagctggaataatgaaaaacccaactgtcgacgggatcgttgcaatagatttggaccctgtagtttacgatgcaaaaattgaaaaacagctaggccaaataatgttgttgatactttgcacatcacagattctcctaatgcggaccacatgggccttgtgtgaatccatcacattggccactggacctctgaccacgctttgggagggatctccaggaaaattctggaacacaactatagcggtgtccatggcaaacattttcaggggaagttatctagcaggagcaggtctggccttttcattgatgaaatctctaggaggaggtaggagaggcacaggagcccaaggagaaacgctgggagaaaaatggaaaagacagctaaaccaattgagcaaatcagaatttaacatttacaagaggagtgggattatagaggtggatagatctgaagccaaagaggggttgaaaagaggagaaacaaccaaacatgcagtgtcgagaggaacggccaaattgaggtggtttgtggaaaggaaccttgtgaaaccagaagggaaagtcattgacctcggttgtggaagaggtggctggtcatattactgcgctgggctgaagaaagtcacagaagtaaaaggatacacgaaaggaggacctggacatgaggaaccaatcccaatggcaacctatggatggaacctagtaaagctacactctggaaaagatgtattctttacaccacctgagaaatgtgacacccttttgtgtgatatcggtgagtcctctccgaacccaactatagaagaaggaagaacattacgtgttctaaagatggtggaaccatggctcagaggaaatcaattttgcataaaaattctaaatccctatatgccgagtgtggtagaaactctggagcaaatgcaaaggaaacatggaggaatgctagtgcgaaatccactctcaagaaactccactcatgaaatgtactgggtttcatgtggaacaggaaacattgtgtcagcagtgaacatgacatctagaatgctgctaaatcgattcacaatggctcacaggaagccaacatatgaaagagacgtggacttaggcgctggaacaagacatgtggcagtggaaccagaggtggccaacctagatatcattggccagaggatagagaatataaaaaatgaacacaaatcaacatggcattatgatgaggacaatccatacaaaacatgggcctatcatggatcatatgaggtcaagccatcaggatcagcttcatccatggtcaatggtgtggtgagactgctaaccaaaccatgggatgtcattcccatggtcacacaaatagccatgactgataccacaccctttggacaacagagggtgtttaaagagaaagttgatacgcgcacaccaaaagcgaaacgaggcacagcgcaaattatggaggtaacagccaggtggttatggggttttctctctagaaacaaaaaacccagaatctgcacaagggaggagtttacaagaaaagttaggtcaaacgcagccattggagcagtgttcgttgacgaaaaccagtggaactcagcaaaagaggcagtggaagatgaacggttttgggaccttgtgcacagagagagagagcttcataaacaaggaaaatgtgccacgtgtgtctacaacatgatgggaaggagagagaaaaaattaggagagttcggaaaggcaaaaggaagtcgcgcaatatggtacatgtggttgggagcgcgctttttagagtttgaagcccttggtttcatgaatgaagatcattggttcagcagagagaattcactcagtggagtggaaggagaaggacaccacaaacttggatacatacttagagacatatcaaagattccagggggaaatatgtatgcagatgacacagccggatgggacacaagaataacagaggatgatcttcagaatgaggcaaaaatcactgacatcatggaacctgaacatgccctattggccacgtcaatctttaagctaacctaccaaaacaaggtagtaagggtgcagagaccagcaaaaaatggaaccgtgatggatgtcatatccagacgtgaccagagaggaagtggacaggttggaacctatggcttaaacaccttcactaacatggaggcccaactaataagacaaatggagtctgagggaatcttttcacctagcgaattggaaaccccaaacctagctgaaagagtcttcgactggttggaaaaacatggcatcgagaggctgaaaagaatggcaatcagtggagatgactgtgtggtgaaaccaattgatgacagatttgcaacagccttaacagccttgaatgacatgggaaaggtaagaaaagacataccgcaatgggaacccccaaaaggatggaacgattggcaacaagtgcctttttgttcacaccatttccaccagctgattatgaaggatgggagggagatagtggtgccatgccgcaaccaagatgaacttgtgggtagggccagagtctcgcaaggcgccggatggagcttgagagaaactgcatgcctaggcaagtcatatgcacaaatgtggcagctgatgtacttccacaggagagatttgagactagcggctaatgccatctgttcagccgttccagttgactgggtcccaaccagccgcaccacctggtcgatccatgcccaccatcagtggatgacaacagaagacatgttgtcagtgtggaatagggtttggatagaggaaaacccatggatggaggacaagactcatgtgtccagttgggaagacgttccatacctagggaaaagggaagatcaatggtgtggatccctaataggcttaacagcacgagccacctgggccacaaacatacaagtggccataaaccaagtgagaaggctcattgggaacgagaactatctagactatatgacatcaatgaagagattcaaaaacgagagtgatcctgaaggagcactctggtga

SEQ ID NO: 6346 - RNA, 9879 nt, synthetic construct
  misc_feature 1..9879: note = derived and/or modified CDS sequence (wt) from DENV-1__HQ332182__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgtttaagacctctgcaggtgtcaacatgtgcactctcattgcgatggacttgggagagttatgtgaggacacaatgacctacaaatgtccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacttgggctttgagacacccaggattcacggtgatagcccttttcttagcacatgccataggaacatccatcactcagaaagggatcattttcattttgttaatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaaccttggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggttgcggactattcggaaagggaagcctattgacgtgtgccaagttcaagtgtgtgacaaaactagaaggaaagatagttcaatatgaaaacttgaaatattcagtgatagtcactgtccacactggggaccagcaccaggtgggaaatgagactacagaacacggaacaattgcaaccataacacctcaagctcctacgtcggaaatacagctgactgactacggagccctcacattggactgctcacctagaacagggctggactttaatgagatggtgctattaacaatgaaagaaaaatcatggcttgtccacaaacaatggtttctagacttaccactgccttggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatctttgcaggacacctgaaatgcagactaaaaatggataaactgactttaaaggggacgtcatatgtgatgtgcacaggctcatttaagctagagaaggaagtggctgagacccaacatggaactgttctagtgcaggtcaaatacgaaggaacagacgcgccatgcaagatccccttttcgacccaagatgagaaaggagtgacccagaatggaagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaactgcccgaggagcacgaaggatggctatcctgggagacaccgcatgggacttcggatctataggaggagtgttcacatctgtaggaaaattggtacaccaggtttttggaaccgcatatggggttctgttcagcggtgtttcttggaccatgaaaataggaatagggattctgctgacatggttgggattaaattcaaggagcacgtcactttcaatgacgtgcattgcagttggcatggttacactgtacctaggagtcatggttcaagcggactcgggatgtgtaatcaactggaagggcagagaacttaaatgtggaagtggcatttttgtcactaatgaagtccacacttggacagagcaatacaagttccaggctgactccccaaaaagactgtcagcagccattggaaaggcatgggaggagggcgtgtgtggaattcgatcagccacgcgtcttgagaacatcatgtggaagcaaatatcaaatgaattgaaccacattctacttgaaaatgacatgaaattcacagtggttgtaggagatgctaatggaattttggcccaaggaaaaaaaatgattaggccacaacccatggaacacaaatactcatggaaaagctggggaaaagctaaaatcataggagcagacatacaaaataccaccttcatcatcgacggcccagataccccagaatgccctgatgaccaaagagcgtggaacatttgggaagttgaggactatgggtttggaattttcacgactaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagttggcgagagcctccttcatagaagtcaagacatgcacctggccgaaatctcacactctatggagcaatggagttttggaaagtgaaatgataatcccaaagatatatggaggaccaatatctcagcacaactacagaccagggtatttcacacaaacagcagggccatggcacctaggcaagttggaattggactttgacttgtgtgaaggtaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcgatggtctctgcagggtcaggagaagtggacagtttttcattgggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattgtttcgcagactaacatccagagaagttcttcttctcacgattggattaagcctggtggcatccgtagagctaccaaattctttggaggagctaggggatggacttgcaatgggtatcatgatgttaaaattattgactgaatttcagccacaccagttatggaccaccttactgtctctgacatttatcaaaacaactctttcattggattatgcatggaaaacaacggctatggcactgtcaatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccatcaatgaaggaatcatggctattggaatagtcagcattctactgagttcactcctcaaaaatgatgtgccgttggccggcccactaatagctggaggcatgctaatagcatgttatgtcatatccggaagctcagccgatttatcattggagaaagcggctgaggtgtcctgggaacaagaagcagaacactcaggtacctcacacaacatattagtagaggtccaagatgacggaactatgagaataaaagatgaagagaaggatgacacactcactatactccttaaagcaactttgctggcagtctcaggagtgtacccaatgtcaataccagcaactctttttgtgtggtatttctggcagaaaaagaaacagagatcaggagtgttatgggacacacccagccctccggaagtggaaagagcagttcttgatgatggcatctatagaatcttgcaaagaggactgttgggcagatcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagtcggagccatagctctagattttaaacccggcacatctggatctcccatcgtgaacagagagggaaaaatagtaggtctttatggaaacggagtggtgacaacaagtggaacctacgtcagtgccattgctcaagctaaagcatcacaggaagggcctctaccagagattgaggacgaggtgttcaagaaaagaaacttaacaataatggacctgcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgaacacacaggaagggagatagtagatctcatgtgccacgccacttttaccatgcgtctcttatccccagtgagagttcccaattacaacatgattattatggatgaagcacatttcaccgatccagccagcatagcggccagagggtacatctcaacccgagtgggtatgggtgaagcagctgcgatctttatgacagccactcccccaggatcggtagaggcctttccacagagtaatgcagttatccaagatgaggaaagagacattcctgagagatcatggaactcaggctacgactggatcactgattttccaggtaaaacagtctggtttgtcccaagcattaaatcaggaaatgacattgccaactgtttaagaaagaacggaaaacgggtaatccaattgagcagaaaaacctttgacactgagtaccagaaaacaaaaaataatgattgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgaccagtatgtttacatgggacagcctttgaataacgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacacttgacgctgagagcccagaatgctctggataacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggtctagggaaaacatccattggcttgctctgtgtgacggcctcaagcgtactgttatggatggccagtgtggagccccattggatagcggcctccatcatactagagttcttcttgatggtgctgctcattccagagccagacagacagcgcactccacaggacaaccagctagcatatgtggtgataggtttgttattcatgatactgacagtggcagccaatgagatgggattattggaaaccacaaagagagacctggggattggccatgtggccgccgaaaaccaccaacatgctacaatgctggacgtagacctacgtccagcttcagcctggactctctatgcagtagccacaacagttatcactcccatgatgagacacacaattgaaaacacaacggcaaacatttccctgacagccattgcaaatcaggcagctatattgatgggacttgacaagggatggccaatatcgaagatggacataggagtcccacttctcgccttagggtgctattcccaggtgaacccattgacactgacagcggcagtgttgatgttagtggctcattatgccataattggaccaggactgcaagcaaaggccactagagaagctcaaaaaaggacagcggccggaataatgaaaaatccaactgtagacgggattgttgcaatagacttggatcctgtggtttatgatgcaaaatttgaaaaacagctaggccaaataatgctactgatactttgtgcatcacaagtcctcttgatgcggaccacatgggccttgtgtgaatccatcacactggcgactggacccctgaccactctctgggagggatctccaggaaaattctggaataccacgatagcagtgtccatggcaaacatcttcaggggaagttatctagcaggagcaggtctggctttctcattgatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactaaaaagaggagaaacaaccaaacatgcagtgtcgagaggaacagctaaactgaggtggtttgtggagaggaacctcgtgaaaccagaagggaaagtcatagacctcggttgtggaaggggtggctggtcatattattgtgctgggctgaagaaagtcactgaagtgaagggatacacaaaaggaggacctggacatgaggaacctatcccaatggcgacctatggatggaacctagtaaagctacactctggaaaagatgtattctttatgccacctgagaaatgtgacacccttttgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtggaacaggaaatattgtgtcggcagtgaacatgacatccagaatgttactgaatcgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtaaatggagtggtgagattgctcacaaaaccatgggatgttatccccatggtcacacaaatagctatgaccgataccacaccctttggacaacagagagtgtttaaagagaaagttgacacgcgcacaccaagagcaaaacgaggcacaacacaaattatggaggtgacagccaagtggttgtggggtttcctttccagaaacaaaaaacccagaatctgcacaagagaggagttcacaagaaaggttaggtcaaacgcagcagtaggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaactaggagagtttggaaaggcaaaaggaagccgtgcaatatggtacatgtggctgggagcacgctttctggagttcgaagcccttggtttcatgaatgaagatcactggtttagcagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacatcaatttttaagctgacctatcaaaataaggtggtgagggtgcaaagaccagcaaaaaatggaaccgtgatggatgttatatctagacgtgaccagagaggaagtggacaggtcggaacttatggcttaaatactttcactaatatggaggtccaactaataagacaaatggagtctgaaggaatctttttacccagcgaattggaaacccccaatctagctgagagagttcttgactggttggaaaaacatggcgccgaaaggctgaaaagaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtaggcagggctagagtatcacaaggcgccggatggagcctgagagaaactgcttgcctaggcaagtcatatgcacaaatgtggcagttgatgtacttccacaggagagacctgagactagcggctaacgccatctgttcagccgtcccagttgattgggtcccaaccagccgcacaacctggtcaattcatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 6347 - RNA, 9879 nt, synthetic construct
  misc_feature 1..9879: note = derived and/or modified CDS sequence (wt) from DENV-1__HQ332181__SS-prME
  source 1..9879: mol_type = other RNA
tccgtgaccatgctcctcatgctgctgcccacagccctggcgtttcatttgaccacacgagggggagagccacacatgatagttagtaagcaggaaagaggaaagtcacttttgtttaagacctctgcgggcgtcaatatgtgcaccctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagagaaacgttccgtggcactggccccacacgtgggacttggtctagaaacaagaaccgaaacatggatgtcctctgaaggcgcctggaaacaaatacaaagagtggaaacttgggctttgagacacccaggattcacggtgatagctttttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaatggctgcggactattcggaaagggaagtctattgacgtgtgccaagttcaagtgtgtgacaaaactagagggaaagatagttcaatatgaaaacctaaaatattcagtgatagtcactgtccacactggggaccagcaccaggtgggaaacgagaccacagaacatggaacaattgcaaccataacacctcaagctcccacgtcggaaatacagctgaccgactacggagccctcacattggactgctcacctagaacagggctggactttaacgagatggtgctattgacaatgaaagaaaaatcatggcttgtccacaaacaatggtttctagacttaccactgccatggacttcgggggcttcaacatctcaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgaccttaaaggggatgtcatatgtgatgtgcacaggctcatttaagctagagaaggaagtggctgagacccagcatggaactgttctagtgcaggtcaaatatgaaggaacagacgcgccatgcaagatccccttttcgacccaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagagaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgtttagcggtgtttcttggaccatgaaaataggaatagggattctgctgacatggttgggactaaattcaaggagcacgtcactttcgatgacgtgcattgcagttggcatggtcacactgtacctaggagtcatggtccaagcggattcgggatgtgtaatcaactggaagggcagagaacttaaatgtggaagtggcatttttgtcactaatgaagtccacacttggacagagcaatacaaattccaggctgactccccaaaaagactgtcagcagccattggaaaagcatgggaggagggcgtgtgtggaattcgatcagccacgcgtcttgagaacatcatgtggaagcaaatatcaaatgaattgaaccacattctacttgagaatgacatgaaattcacagtggttgtaggagatgccaacggaattttggtccagggaaaaaaaatgattaggccacaacccatggaacacaaatactcatggaaaagctggggaaaagctaaaatcataggagcagacatacaaaataccaccttcatcatcgacggcccagacaccccagaatgtcccgatggccaaagagcatggaacatttgggaagtagaggactatgggtttggagttttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctccttcatagaagtcaagacatgcacctggccgaaatctcacactctatggagcaatggagttttggaaagtgaaatgataatcccaaagatatatggaggaccaatatctcagcacaactacaggccagggtatttcacacaaacagcagggccatggcacctaggtaagttggaattggattttgacttgtgtgaaggtaccacagttgttgtggatgaacattgtggaaatcgaggtccatctctcagaaccacaacagtcacaggaaagataatccatgaatggtgttgcagatcctgcacgctaccccccttacgtttcagaggagaagacgggtgttggtatggcatggaaatcagaccagtaaaggagaaggaggagaatctagttaggtcaatggtttctgcagggacaggagaagtggatagtttttcattaggaatactatgcgtatcaataatgattgaagaagtgatgagatccagatggagtagaaagatgctgatgactggaacactggctgttttcctccttcttataatgggacaattgacatggaatgatttgattaggttatgcatcatggttggagctaatgcttcagacaggatggggatgggaacaacgtacctagccttgatggctactttcaaaatgagaccaatgttcgctgttgggctattattccgcagactaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttattgtctctgacatttgtcaaaacagctctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagctggcccctcaatgaaggaattatggctattggaatagtcagcattctactaagctcactcctcaaaaatgatgtgccgttggccgggccactaatagctggaggcatgctaatagcatgttatgtcatatccggaagctcagccgatttatcattggagaaagcggctgaagtatcctgggaacaagaagcagaacactccggtgcctcacacaacatattagtagaggtccaagatgatggaactatgaaaataaaagatgaagagagggatgacacactcactatacttcttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgacaatggcatctatagaatcttgcaaagaggactgttgggcaggtcccaagtaggagtgggagtcttccaagacggcgtgttccacacaatgtggcacgttaccaggggagctgtccttatgtaccaagggaagagactggaaccaagctgggccagtgtcaaaaaggacttgatctcatatggaggaggttggaggttccaaggatcatggaacacgggagaagaagtgcaggtgatagctgttgaaccaggaaaaaaccccaaaaatgtacagacaacgccaggcaccttcaagactcctgaaggcgaagttggagccatagctctagatttcaaacccggcacatctggatctcccattgtgaacagagagggaaaaatagtgggtctgtatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcagggaaaacaagaagatatcttccagccatagtccgtgaggccataaaaaggaaactgcgtacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagctagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggattactgactttccaggtaaaacagtctggtttgttccaagcattaaatcaggaaatgacattgccaactgtttaagaaagaacggaaaacgggtaatccaattgagcagaaaaacctttgacactgagtaccagaaaacaaaaaacaatgactgggactatgttgtcacaacagacatttctgaaatgggggcaaatttccgggccgacagggtaatagacccaaggcggtgcttgaaaccggtaatactaaaagatggtccagagcgtgtcattctagccggaccgatgccagtgactgtggccagtgctgcccagaggagaggaagaattggaaggaaccaaaacaaggaaggtgaccagtatgtttatatgggacagcctttaaacaatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggacgccagaacatactctgatccattggccctgcgcgagtttaaagagttcgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacatgctatggaggaactaccagacaccatagaaacattgatgcttctagctttgatagctgtgttgactggtggagtgacgctgttcttcctatcaggaaaaggcctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacatgctacaatgctggacgtagacctacacccagcttcagcctggaccctctatgcagtagccacaacagttatcactcccatgatgagacacacaattgaaaatacaacggcaaacatttccctgaccgccattgcaaatcaggcagctatattgatgggacttgacaagggatggccaatatcgaagatggacataggagttccacttctcgccttagggtgctattcccaggtgaacccattgacactgacagcggcggtgttgatgttagtagctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatccatcacactggctactggacccctgaccactctctgggagggatctccaggaaaattctggaataccacaatagcagtgtccatggcaaacatcttcaggggaagttatctagcaggagcaggtctggctttctcattaatgaaatctttaggaggaggtaggagaggtacgggagctcaaggggaaacactgggagagaaatggaaaagacagttaaaccaactgagcaagtcagaattcaatacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatattattgtgctgggctgaagaaagttactgaagtgaagggatacacaaaaggaggacctggacatgaggaacctatcccaatggcgacctatggatggaacctagtaaagctacactctggaaaggatgtattttttatgccacctgagaaatgtgacacccttctgtgtgatattggtgagtcctctccgaatccaactatagaagaaggaagaacgttacgtgttctaaaaatggtggaaccatggctcagaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcataggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgatacgcgcacaccaagagcaaaacgaggcacaacacagattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcagcaaaagaagcagtggaagacgaaaggttttgggatcttgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagaccactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgatcagagaggaagtggacaggtcggaacttatggcttaaatactttcaccaatatggaggtccaactaataagacaaatggagtctgaaggaatctttctacccagcgaattggaaacccccaacctagctgagagggctcttgactggttagaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggaaccttcaaaaggatggaatgattggcagcaagtgcctttttgttcacaccatttccaccagctgatcatgaaggatgggagggaaatagtggtgccatgccgcaaccaagatgaacttgtgggcagggctagagtatcacaaggtgccggatggagcctgagagaaactgcttgcctaggcaagtcatatgcacaaatgtggcagctgatgtacttccacaggagagacctgagactagcggctaacgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctaggaaaaagggaagatcaatggtgtggatccctgataggcttgacagcgagggccacctgggccaccaacatacaagtagctataaaccaagtgagaaggctcatcgggaatgagaattatttagattacatgacatcaatgaagagattcaagaatgagagtgattccgaaggagcactctggtaa

SEQ ID NO: 6348 - RNA, 9879 nt, synthetic construct
  misc_feature 1..9879: note = derived and/or modified CDS sequence (wt) from DENV-1__HQ332180__SS-prME
  source 1..9879: mol_type = other RNA
tccgtgaccatgctcctcatgctgctgcccacagccctggcgttccatttgaccacacgagggggagagccacacatgataattagtaagcaggaaagaggaaagtcactcttgtttaagacctctgcaggtgtcaatatgtgcactctcattgcgatggacttgggagagttatgtgaggacacaatgacctacaaatgcccccggattactgaggcggaaccagatgacgttgactgctggtgcaacgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataagccaacattggacattgaactcttgaagacggaggtcacaaatcctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaagtgtgtgacaaaactagaaggaaagatagttcaatatgagaacttaaaatattcagtgatagttaccgtccacactggggaccagcatcaggtggggaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacaatggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggacaaactgactttaaaggggatgtcatatgtgatgtgcacaggctcattcaagctagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagccatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacattatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctcttagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgtgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgcacctagccttgatggctactttcaaaatgagaccaatgttcgctgttgggctattattccgcagattaacatccagagaagttcttctcctcacgattggattaagcctgatggcatccatggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatgatactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaatcatggctattggaatagtcagcattctactaagttcactcctaaaaaatgatgtgccattggccggcccactaatagctggaggcatgctaatagcatgttatgtcatatccggaagctcagccgatttatcattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaacagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccaggatcaggaaaaacaagaagatatcttccagccatagtccgtgaggccataaaaaggaaactgcgtacgttaatcttggctcccacaagagtcgttgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcaccgactttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcggcctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaattccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccggcttcagcctggaccctctatgcagtagccacaacagttatcactcccatgatgagacatacaattgaaaatacaacggcaaacatttccctgacagccattgcaaatcaggcagctatattgatgggacttgacaagggatggccaatatcgaagatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttagatcctgtggtttatgatgcaaaatttgaaaaacagctaggccaaataatgttactgatactttgtacatcacagatcctcttgatgcggaccacatgggccttgtgtgaatccattacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgttacgtgttctaaaaatggtggaaccatggctcaaaggaaaccaattctgcataaaaatcctaaatccttacatgccaagtgtggtagaaactctggagcaaatgcaaagaaaacatggagggatgctagtgcgaaacccactctcaagaaattctacccatgaaatgtattgggtttcatgtggaacaggaaacattgtgtcggcagtgaacatgacatccagaatgttactgaaccgattcacaatggctcacaggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagattgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaagcccagaatctgcacaagagaggagttcacaagaaaagttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaacgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaatcaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgccatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 6349 - RNA, 9879 nt, synthetic construct
  misc_feature 1..9879: note = derived and/or modified CDS sequence (wt) from DENV-1__HQ332179__SS-prME
  source 1..9879: mol_type = other RNA
tccgtgaccatgctcctcatgctgttgcccacagccctggcgttccatttgaccacacgagggggagagccacacatgatagttagtaagcaggaaagaggaaagtcactcttgtttaagacctctgcaggtgtcaatatgtgcactctcattgcgatggacttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggacttggtctagaaacaagaaccgaaacatggatgtcctctgaaggcgcctggaaacaaatacaaagagtggagacctgggctttgagacacccaggattcacggtgatagccctttttttagcacatgctataggaacatccatcactcagaaagggatcattttcatcttgctgatgctggtgacaccatcaatggccatgcgatgcgtgggaataggcaacagagacttcgttgaaggactgtcaggagcaacgtgggtggacgtggtattggagcatggaagctgcgtcaccaccatggcaaaaaataaaccaacattggacattgaactcttgaagacggaggtcacgaaccctgccgtcttgcgcaaactgtgcattgaagctaaaatatcaaacaccaccaccgattcaagatgtccaacacaaggagaggctacactggtggaagaacaagacgcgaactttgtgtgtcgccgaacgtttgtggacagaggctggggtaacggctgcggactattcggaaagggaagtctattgacgtgtgccaagttcaaatgtgtgacaaaactagaaggaaagatagttcaatatgagaacttaaaatattcagtgatagttaccgtccacactggggaccagcatcaggtgggaaacgagaccacagaacatggaacaattgcaaccataacacctcaagctcctacgtcggaaatacagctgaccgactacggagcccttacattggactgctcacctagaacagggctggactttaatgagatggtgctattgacaatgaaagaaaaatcatggcttgtccacaaacagtggtttctagacttaccactgccatggacttcgggggcttcaacatcccaagagacctggaacagacaagatttgctggtcacattcaagacagctcatgcaaagaaacaggaagtagtcgtactgggatcacaggaaggagcaatgcacactgcgttgactggggcgacagaaatccagacgtcaggaacgacaacaatcttcgcaggacacctgaaatgcagactaaaaatggataaactgactttaaaggggatgtcatatgtgatgtgcacaggctcattcaagttagagaaggaagtggctgagacccagcatggaactgttctagtgcaggtcaaatacgaaggaacagacgcgccatgcaagatccccttctcgactcaagatgagaaaggagtgacccagaatgggagattgataacagccaatcccatagttactgacaaagaaaaaccagtcaacattgagacagaaccaccttttggtgagagctacatcgtggtaggggcaggcgaaaaagctttgaaactaagctggttcaagaaaggaagcagcatagggaaaatgttcgaagcaaccgcccgaggagcacgaaggatggctatcctgggagacaccgcatgggacttcggttctataggaggagtgtttacatctgtgggaaaattggtacaccaggtttttggaaccgcatatggggttctgttcagcggtgtttcttggaccatgaaaataggaatagggattctgttgacatggttgggattaaattcaaggagcacgtcactttcgatgacgtgcattgcagttggcatggtcacactgtacctaggagtcatggttcaagcggactcgggatgtgtgatcaactggaagggcagagaacttaaatgtggaagtggcatttttgtcactaatgaagtccacacttggacagagcaatacaaattccaggctgactccccaaaaagactgtcagcagccattggaaaggcatgggaggagggagtgtgtggaattcgatcagccacgcgtcttgagaacatcatgtggaagcaaatatcaaatgaattgaaccacattctacttgaaaatgatatgaaattcacagtggttgtaggagatgctaacggaattttggcccaagggaaaaaaatgattaggccacaacccatggaacacaaatactcatggaaaagctggggaaaagctaaaatcataggagcagacatacaaaataccacctttatcatcgacggcccagacaccccagaatgtcccgatggccaaagagcatggaacatttgggaagttgaggactatgggtttggaattttcacgacaaacatatggctgaaattgcgtgactcctacacccaaatgtgtgaccaccggctaatgtcagctgccatcaaggacagcaaggcagttcatgctgacatggggtactggatagaaagtgaaaagaacgaaacctggaagctggcgagagcctccttcatagaagtcaagacatgcacctggccaaaatctcacactctatggagcaatggagttttggaaagtgaaatgataatcccaaagatatatggaggaccaatatctcagcacaactacaggccagggtatttcacacaaacagcagggccatggcacctaggtaagttggaactggattttgacttgtgtgaaggcaccacagttgttgtggatgaacattgtggaaatcgaggtccatctctcagaactacaacagtcacaggaaagataatccatgaatggtgttgcagatcctgcacgttaccccccttacgtttcagaggagaagacggatgttggtatggcatggaaatcagaccagtaaaggagaaggaggagaatctagttaggtcaatggtctctgcagggtcaggagaagtggacagtttttcattaggaatactatgcgcatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaggatggggatgggaacaacgtacctagccttgatggctactttcaaaatgagaccaatgttcgctgttgggctattattccgcagattaacatccagagaagttcttctcctcacgattggattaagcctggtggcatccgtggagctaccaaattctttggaggagctaggggatggacttgcaatgggtatcatgatgttaaaattgttgactgaatttcagccacaccagttatggaccaccttactgtctttgacatttgtcaaaacaactctctcattggattatgcatggaaaacaacggctatggtactgtctatcgtatctctctttcctttatgcctgtctacgacctcccaaaaaacaacatggcttccggtgctgttaggatcttttggatgcaaaccattaaccatgtttcttataacagaaaacaaaatctggggaaggaaaagttggcccctcaatgaaggaattatggctattggaatagtcagcattctactaagttcactcctaaaaaatgatgtgccattggccggcccactaatagctggaggcatgctaatagcatgttatgtcatatccggaagctcagccgatttattattggagaaagcggctgaggtgtcctgggaacaagaagcagaacactccggtgcctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatctatagaatcttgcaaagaggactgttgggcaggtcccaagtaggagtgggagtcttccaagacggcgtgttccacacaatgtggcacgtcaccaggggagctgtccttatgtaccaagggaagaggctggaaccaagctgggccagtgtcaaaaaggacttgatctcatatggaggaggttggagatttcaaggatcatggaacacgggagaagaagtgcaggtgatagctgttgaaccaggaaaaaaccccaaaaatgtacagacaacgccgggtaccttcaagactcctgaaggcgaagttggagccatagctctagatttcaaacccggcacatctggatctcccattgtgaatagagagggaaaaatagtgggtctttatggaaatggagtggtgacaacaagtggaacctacgtcagtgccattgcccaagctaaagcatcacaggaagggcctctaccagagattgaggacgaggtgtttaagaaaagaaacttaacaataatggacctgcacccgggatcaggaaaaacaagaagatatcttccagccatagtccgtgaagccataaaaaggaaactgcgcacgttaatcttggctcccacaagagttgtcgcctctgaaatggcagaggcactcaagggaatgccaataagatatcagacaacagcagtgaagagtgaacacacaggaagggagatagttgacctcatgtgccacgctacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaactcaggctacgactggatcactgattttccaggtaaaacagtctggtttgttccaagcattaaatcaggaaatgacattgccaactgtttaagaaagaacggaaaacgggtaatccaactgagcagaaaaacctttgacactgagtaccagaaaacaaaaaacaatgactgggactatgttgtcacaacggacatttccgaaatgggggcaaatttccgggccgacagggtaatagacccaaggcggtgcttgaaaccggtaatactaaaagatggtccagagcgtgtcattctagccggaccgatgccagtgactgtggccagtgctgcccagagaagaggaagaattggaaggaaccaaaacaaggaaggtgatcagtatgtttacatgggacagcctttaaataatgatgaggatcacgctcattggacagaagcaaaaatgctccttgacaacataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagtagcctcagaaggtttccagtactccgacagaaggtggtgctttgatggggaaaggaacaaccaggtgttggaggagaacatggacgtggagatctggacaaaggaaggagaaagaaagaaattgcgacctcgctggttggatgccagaacatactctgatccactggctctgcgcgagtttaaagagtttgcagcaggaagaagaagtgtctcaggtgacctaatattggaaatagggaaacttccacaacatttgacgctaagagcccagaatgctctggacaacttggtcatgttgcacaactccgaacaaggaggaaaagcctacagacacgctatggaggaactaccagacaccatagaaacattgatgcttctagctttgatagctgtgttgactggtggagtgacgctattcttcctatcaggaaaaggtttagggaaaacatctattggcttgctctgtgtgacggcctcaagcgcactgttatggatggcctgtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggctatgtagccgccgaaaaccaccaacacgctacaatgctggacgtagacctacgcccagcttcagcctggaccctctatgcagtagccacgacagttatcactcccatgatgagacacacaattgaaaatacaacggcaaacatttccctgacagccattgcaaatcaggcagctatattgatgggacttgacaagggatggccaatatcgaaaatggacataggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactctgtacatcacagatcctcttgatgcggaccacatgggccttgtgtgaatccatcacactggctactggacccctgaccactctctgggagggatctccaggaaaattctggaataccacgatagcagtgtccatggcaaacatcttcaggggaagttatctagcaggagcaggtctggctttttcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaaggaaaagtcatagacctcggttgtggaagaggtggctggtcatactattgtgctgggctgaagaaagttactgaagtgaagggatacacaaaaggaggacctggacatgaggaacctatcccaatggcgacctatggatggaacctagtaaagctacactctggaaaagatgtattttttatgccacctgagaaatgtgacacccttctgtgtgatattggtgagtcctctccgaatccaactatagaagaaggaagaacgctacgtgttctaaaaatggtggaaccatggctcaaaggaaaccaattctgcataaaaatcctaaatccttacatgccaagtgtggtagagactctggagcaaatgcaaagaaaacatggagggatgctagtgcgaaacccactctcaagaaattctacccatgaaatgtattgggtttcatgtggaacaggaaacatcgtgtcggcagtgaacatgacatccagaatgttactgaaccgattcacaatggctcacaggaagccaacatatgaaagagacgtggacttaggcgctggaacaagacatgtggcagtggaaccagaggtagccaatctagatattattggccagaggatagagaatataaaaaatgaacacaagtcaacatggcattatgatgaggacaatccatacaaaacatgggcctatcatggatcatatgaggtcaagccatcaggatcagcctcatctatggtgaatggagtggtgagactgctcacaaaaccatgggatgttatccccatggtcacacaaatagctatgactgataccacaccctttggacaacagagagtgtttaaagagaaagttgacacgcgcacaccaagagcaaaacgaggcacaacacaaattatggaggtgacagccaagtggttatggggtttcctttccagaaacaaaaaacccagaatctgcacaagagaggagttcacaagaaaggttaggtcaaacgcggcaataggagcagtgttcgttgatgaaaaccaatggaactcggcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaagcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacttatcaaaacaaggtggtgagggtgcaaagaccagcaaaaaatggaaccgtgatggatgttatatccagacgtgaccagagaggaagtggacaggtcggaacttatggcttaaatactttcaccaatatggaggtccaactaataagacaaatggagtctgaaggaatctttttacccagcgaattggaaactcccaacctagctgagagagttcttgactggttggaaaaacatggcgccgaaaggctgaaacgaatggcaatcagcggagatgattgcgtggtgaaaccaattgacgacaggttcgcaacagccttaacagctctgaatgacatgggaaaagtaagaaaagacataccgcagtgggagccttcaaaaggatggaatgattggcagcaagtgcctttctgttcacaccatttccaccagctgatcatgaaggatgggagggaaatagtggtgccatgccgcaaccaagatgaacttgtgggcagggccagagtatcgcaaggcgccggatggagcctgagagaaactgcttgcctaggcaagtcatatgcacaaatgtggcagctgatgtacttccacaggagagacctgagactagcggctaacgctatctgttcagccgttccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcctgaaggagcactctggtaa

SEQ ID NO: 6350 - RNA, 9879 nt, synthetic construct
  misc_feature 1..9879: note = derived and/or modified CDS sequence (wt) from DENV-1__KR919820__SS-prME
  source 1..9879: mol_type = other RNA
actgtggttgcacttcttatgttactacccatggttttttcatttcatctgaccacccgtggaggagagccccacatgattgtcaataaacaggagagaggaaaatcccttttgtttaaaacttcagggggtattaacatgtgcaccctcattgcaatggacttgggggatctatgtgaagacacaatgacatacaaatgccctcggattactgaagcggaaccggatgatgttgactgctggtgcaacgccacagacacatgggtcacatacggaatatgttctccaactggtgaacacaggagagaaaaacgctcagtggcccttgcccctcatgttggactcggcttggagacaagagctgaaacatggatgtcttcagaaggagcctggaaacaaatacaaagagttgagacttgggctttacgacacccaggtttcacagtaatagcccttttcctggcgcatataataggaacatccataactcagaaaggagttatcttcatcttgttgatgctggtgaccccgtcaatggccatgagatgcgttggagtggggaacagagactttgtagaaggactttcaggagcaacatgggtggatgtggtgctagaacatggaagctgtgttacaacaatggcaaaaaataaaccaactctggacatagagcttctaaaaacagaggtttcgaaccctgccgttttacgcaaattgtgcattgaagctaggatatcaaacaccaccactgactcgagatgcccaacacagggtgaggcttcattatcagaggagcaggacaccaactttgtgtgccgcagaacgctcgtggacagaggttggggaaatggttgtggactattcggaaaaggcagtctgataacatgtgccaagtttgaatgcctgacaaagatggaaggtaaaatagttcagtatgaaaacttgaagtactcagtaattgtcactgtgcacactggggatcagcaccaagtaggaaatgaaaccacagggcatggaacaactgcaaccattactccccaagctcccacatcagaaatacaattgactgactacggagctctcacccttgattgctcacctagaacaggattagacttcaatgagatggtgttgctaacaatgaaagagaaatcatggcttgtccacaaacaatggttcctggacctgccattgccatgggcttcaggggcgtcctcacctcaggagacttggaacagacaggacctactggtaacattcaaaacagcccatgcaaagaaacaagaagtagtcgtattgggatcccaagaaggagcaatgcatacggcattgactggagcgacagagatccagacgtcaggaacaacaacaatctttgcgggacatctaaaatgtaggttgaaaatggataaactcacattgaaaggcatgtcatatgtgatgtgcacaggctcattcaagttaaagaaggaagtggccgaaactcaacatggcactgttttggtacaagtagaatatgagggaacagacgccccttgtaagatcccctttacaacgcaagatgaaaaaggggttatccagaatggaagactaataacagccaaccccatagttactgacaaggagaagcctgtgaatattgaagcagaacccccctttggtgaaagctatatggtgataggggtaggtgacaaagcactaaaactgagttggtttaaaaaagggagtagtttagggaaaatgtttgaagcaactgcaagaggggcacgcagaatggccatcctgggtgacacagcttgggatttcggttccgtggggggagtattcacatcaatggggaagttggtacatcaaatttttggaaccgcatatggagttctttttagcggtgtttcttggacgatgaaaataggaataggacttctgctaacttggcttggactaaattcaagaagcacatctctctcaatgacatgcatagcagtaggtataataacactatatctaggagtcatggttcaggctgatacaggatgtgtagtcaactggaaaggaagagaactgaaatgtggaagtggcatttttgtcactaacgaggtccacacttggaccgaacaatacaagttccaagcggactctccaaagaggttatcggctgccattggaaaagcatgggaagatggcgtgtgtggaattcgatcagccactcgtcttgagaacatcatgtggaagcaaatagcaaatgagttgaactacatcttacttgaaaatgacatgaagttcacagtggttgtgggagatgtcaagggaattttaactcaggggaagaaaggcatcaggccacaaccaatggaacataagtattcttggaaaagttggggaaaggcaaaaataattggagccgatgtacagaacactaccttcatcattgatggtccagacaccccagaatgtcctgacagccaaagagcatggaacatctgggaggttgaagattatggctttggaattttcacaacaaacatttggttgaaactacgtgactcttatactcaagtgtgtgaccacagactgatgtctgctgccataaaagacagcagagcggtccacgcagatatggggtactggattgagagtgagaaaaatgagacttggaagttatcaagagcctcctttatagaggtgaaaacatgcacatggccgaaatcccacactctatggagcaacggagtcctggagagtgaaatgataataccaaaaatctatggtggaccaatctcacaacataactatagaccagggtatttcacacaaacagcaggaccatggcatctaggaaaactagaactggattttgacctctgtgagggaactaccgtggtcgtggatgaacaatgcggaaaccgcggtccatcccttagaaccacaacagtcacaggaaaaatcatccatgaatggtgctgcaggtcctgcacactaccacccctacggtttaaaggagaggatggctgctggtatggtatggagattagacctgtgaaagaaaaagaagaaaatctggtgaagtcaatggtctcagcaggctcagggaaagttgacaacttctcacttggattactctgtatatcaattatggtagaagaggttatgagatctaggtggagtggaaagatgctgatgactggaaccatggcagtgttcctcttgttagtgatgggacagctcacatggaatgacttaattagggtgtgcattatggtaggagctcacgctttagacagcatgggaatgggcacgacctatttagcgttgatggccactttcaaaataagaccaatgcttgccgtgggactcttgtttcgcaaactaacatcgagagaaattctcctactcacaattggattgagtttaataacgccagtggaacttcccaactctatagaagagctaggagatgggttagctatgggtattatgatgctgaaattgctgactgatttccaaccataccagctatgggctactttgttgtctttgacatttgtcaagaccactctctccctgcattatgcatggaagactgcagccatggttctgtcaattgtgtcccttctccctttgtgtttatcaacaacttcccagaaaacaacctggctcccaatattgctgggatctcttggatgcaagccattgaccatgtttctcatatccgaaaacaagatctggggaaggagaagttggccaattaatgagggaataatggccgtaggtatagttagcattttgatgagctcactcctgaaaaatgatgtgccgttggccgggccgttgatagcgggaggcatgcttgtggcctgctatgtcatatctggaagttcggctgacttaacattagaaaaaacagctgaggtgtcctgggaggaggaagcagagcactcaggcacggctcataacatactagtggaagtgcaggatgatgggaccatgaaaataaaagatgaagagagagaagacacactaacaatactgctgaaagcagctctcctagcactatcaggagtatacccaatgtccataccagccacactttttgtgtggtatttttggcaaaagaagaaacagagatcaggagttctgtgggacatccctagtcccccagaggttgaaaaagcagtcctcgatgatggtatctataggatactgcagagaggtgtgtttggcagatcacaggtgggggtgggtgttttccaggaaggcgtgtttcatacaatgtggcacgtcaccaggggagccgttctcacataccaagggaaaagattagaaccaagctgggccagtgtgaaaaaagatctgatatcatatggagggggctggagactccaaggctcttggaacgtgggagaagaagtccaagtgattgctgttgagccaggaaaaaacccaaagaatgtgcagactgtacctgggacattcaaaactcacgaaggtgaagttggagctatagccttggacttcaaacccggcacgtctggctcccccattgtgaatagagatgggaaggtggtaggtctgtacggaaatggagtggtgacaacgagcggaacttatgttagtgccatagcacaatcaaaagtatcacaggaaggacctttgcctgagattgaagatgaagttttcaagaaaaagaatttaacaatcatggatctccatccaggatcagggaaaacaaggagatatctcccagcgattgttcgagagtccataaaaagaagattgcgcacactgattttggctcccacaagagtagtggcatcagaaatggctgaggcgcttaaaggcttgccaattagataccaaacaacagctgtaagaaatgaacatacaggaagggaaatagtggaccttatgtgccatgccacgttcaccatgcgccttctgtccccggtaagagtccccaattacaacatgatcatcatggacgaagcacatttcactgatccggctagcatagcagctagggggtacatttcaactcgagtgggcatgggtgaagctgctgcgatcttcatgaccgccacgcccccagggtcagcagaggcctttcctcagagcaactcagtcatctatgatgaggaaaaagatattccagaaaggtcatggaactcaggctatgattggatcactgacttccaaggaaagaccgtttggttcgttccaagcattaaaacaggaaacgacattgctaattgcttgagaaaaaatgggaaacgggtcatccagttgagtaggaaaacttttgacacagaataccaaaagacaaaaaatagtgattgggatttcgttgtgaccacagacatatctgaaatgggagcgaactttagagctgacagggtcatagatccgagacggtgcttgaaaccagttatattaagggatggcccggaacgagtcattctggcagggccgatgccagtaactgttgccagtgctgcacaaagaagaggaagaattggaagaaaccaaagtaaggagggtgaccagtacatatacatgggacagccactcaataatgatgaggaccatgctcattggacagaagccaaaatgcttcttgacaacatcaacacaccagaaggaatcattccagctcttttcgaacctgagcgggaaaaaagtgcagccatagatggggaatacagattaagaggtgaggccaggaaaacgtttgtggagctcatgagaaggggagacctacccgtatggttgtcctacaaagtggcctcggaaggcatacagtacgctgatagaaagtggtgctttgatggagaaaggaacaatcaaattttggaagagaacatggacgtggaaatctggacaaaagaaggagaaaggaagaagctgagacctcgctggctagatgccaggacgtattccgatccactggctctgagggagtttaaggagtttgcagctggaagaagaagcgtctcaggcgatctgatactagaaataggaaaactcccacatcacctaacacagagggcacagaatgcactagacaatttggtcatgctacacaactcagaacaaggggggagggcatacagacatgcaatggaagagctgcctgatacaatagaaacactaatgttattagccatgatagccacgctgactggtggagttgcattgttttttctgtcagggaaaggcctgggaaagacctccattggccttctatgcgtgatggcttcaagcacattgctctggatggctagtgtagagccccactggatagctgcttccattgttttggaattctttctcatggttctactcattccagaaccagataggcagcgcaccccacaggacaaccagctagcgtatgtggtgataggtctgctggtactgatactgacggtagcggccaatgagatgggactcctggaaaccacaaagaaggaccttggaataggttctgcggcggcagaaatccagcatcacaccacaattttagacgtggaccttcatccggcctcagcttggacgttatacgcagtggccacgacagtcatcactccaatgttaaggcacacaatagagaacacaacagcaaacatgtccctcacagcgatcgcaaaccaggcagctatattgatggggcttgacaaaggatggcccatatcaaagatggacataggagttcccctcctagcactaggctgctactctcaagtcaaccctatgacattaaccgcagcagtgctgatgttggtagcccactacgccataataggcccaggattgcaagcaaaagcaacaagagatgcccaaaaaaggacggcagctggaatcatgaaaaatccgactgttgatggaattgtggcgatagatctagatccagtagtgtatgatacaaagtttgaaaaacaactaggccaaattatgctgctgatactctgcacatcacagatcctgctgatgcggaccacatgggctttttgtgaatccatcacactagctaccggaccgttgaccacgctctgggaaggatctccaggaaagttctggaatactacaatagcagtttctatggcaaacatcttcagaggaagttacctggctggggcaggtctggctttttccttgatgaaatcattaggagggaacaggagaggaacaggagcccaaggagaaacattaggggagaaatggaagaggcagcttaatcaactgagcaaactagagttcaacacttacaaaaggagcggaataatggaggtggacagaacagaggctaaggaagggttgaaaagaggtgaaacaactagacatgcagtgtcaagaggaactgccaaactgaggtggtttgtggaaagaaatctcgtgaaacccgaaggaaaagtcattgatcttggttgcggaagaggaggttggtcatactattgcgcagggttgaaaaaagtcacagaggtgaaagggtacacgaaaggaggaccaggacatgaggaaccaattccaatggcgacatatggatggaacttagtgaaattacactctgggaaagatgtgttctttatcccacctgaaaagtgtgacactcttctctgcgacataggtgaatcttctccaaatccaaccattgaggaaggaagaacactacgggttctaaagatggtagagccttggctgagaggaaaccaattctgcataaaagttctaaatccctacatgccaagtgtagtagaaaccttagagcgaatgcaaagaaaacatggagggatgcttgtgcgaaacccattgtcacggaactcaacccacgaaatgtattgggtttcatgtggaacagggaacattgtgtctgcagtgaacatgacttccagaatgttgctaaacagatttacaatgacacataggaagcctacgtatgaaaaggatgtggacttgggtgccggaaccagacacgtggcggtagaaccagaggtggccaatttagacataattggacagagaatagagaatataaaaaatgaacacaaatcaacgtggcactatgatgaagataacccatacaaaacgtgggcataccatggatcatatgaggtaaaaccatcaggatcagcttcgtcaatggttaatggtgtggtaagactgctaacaaaaccatgggatgtcatccccatggtcacacaaatagccatgactgacacaacgccctttggacaacaaagagttttcaaagagaaagttgacacaagaacgcccaaagcaaaaagaggaactgcacaagtcatggagataacagccggctggttgtggaaatttctctccagaaaaaagaagcctagaatatgcacaagagaggagttcacaagaaaggtcaggtcaaatgctgcaataggagcggtatttgtcgacgaaaatcagtggaattcagcaaaggaagctgtggatgatgaacggttctgggatcttgtgaacagagagagggagcttcataaacaaggaaaatgcgccacatgtgtctacaatatgatgggaaaaagagagaagaaactaggtgagtttggaaaggccaaaggaagtcgtgcaatatggtacatgtggcttggggcacgatttctagagtttgaagctcttggttttatgaatgaagaccactggttcagtagggacaactcattgagcggagtagagggagaaggacttcacaagctcggctacatcctcagggacatcgcaagaatcccaggtggaaacatgtatgcagatgacacggccggatgggacacaaggattacggaagaagacctccaaaatgaagcaagagtgacagaacttatggaacctgaccatgcacagctggccacgtcaatattcaggctaacttatcagaataaggttgtgagggtgcagagacctggaaagaatggaacagtaatggatgtcatatccaggcgagaccagaggggaagcggacaggttggaacttacggtcttaataccttcactaatatggaagcccagctgataagacagatggaatccgagggagtattttctcctagtgaattggaaactcccaatttggccaatagagttctggactggctggaaaagtatggtgtggaaaggctgaagaggatggccatcagtggagatgattgcgtggtgaaaccaattgatgacagatttgcaacagctttgactgcactgaatgacatgggaaaagtgagaaaagacatacctcaatgggagccatcaagaggatggaatgactggcagcaagtaccgttctgctcgcaccatttccatcaattgataatgaaggatggtagagagatagtagtgccatgtcgaaaccaagatgaactcgtgggaagggccagagtgtcacagggcgctggctggagcctacgagaaacagcttgcttaggcaaatcgtacgcgcagatgtggcaactgatgtactttcacaggagagacctgagactagccgctaatgctatctgttcggccgtcccagtagactgggttccaaccagccgcaccacatggtcaatccacgctcaccaccaatggatgacaacagaagacatgctttcagtttggaacagagtctggatagaagaaaacccatggatggaggataaaactcatgtgaccagttgggaagacgttccatacctgggaaagagagaagatcaatggtgtggatctttaataggtctatcagctagggcaacctgggcaatcaatatacaagtggccataaaccaggttagaaagctcattggaaatgagcattaccaggattacatgacatcaatgagaaggttcaagaatgaaagtgaaccggaaggagcattgtggtaa

SEQ ID NO: 6351 - RNA, 9879 nt, synthetic construct
  misc_feature 1..9879: note = derived and/or modified CDS sequence (wt) from DENV-1__DQ285561__SS-prME
  source 1..9879: mol_type = other RNA
tctgtgaccatgctcctcatgctattgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgccatagggacatctatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagatttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtcccaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggactatgaaaataggaatagggattctgctgacatggctgggattaaactcaaggagcacgtctctttcaatgacgtgtatcgcagttggcatgatcacactgtacctaggagtcatggtccaggcggactcgggatgtgtaatcaactggaaaggcagagaactcaaatgtggaagtggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttcccaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtttcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttctagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactggtttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaagaaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttacagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgacatgggaaaggtaagaaaagacataccgcaatgggaaccttcaaaaggatggaatgattggcaacaagtgcctttctgctcacaccacttccaccagctgattatgaaggatggaagggaaatagtagtgccgtgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 6352 - RNA, 9879 nt, synthetic construct
  misc_feature 1..9879: note = derived and/or modified CDS sequence (wt) from DENV-1__DQ285562__SS-prME
  source 1..9879: mol_type = other RNA
tccgtgaccatgctccttatgctgctgcccacagccctggcgttccatttgaccacacgagggggagagccacacatgatagtcagcaagcaggaaagaggaaagtcactcttgtttaagacctctgcaggtgtcaacatgtgcaccctcattgcaatggatttgggagagttatgtgaggacacaatgacctacaaatgcccccggatcactgaagcggaaccagatgatgttgattgctggtgcaatgccacagacacatgggtgacctatgggacgtgttctcaaactggcgaacaccgacgggataaacgttctgtcgcattggccccacacgtagggcttggtctagaaacaagaaccgaaacgtggatgtcctctgaaggcgcctggagacagatacaaaaagtggagacttgggccttgagacacccaggattcacggtgatagccctttttttagcgcataccataggaacatccatcacccagaaagggatcatcttcattttgctgatgctggtgacaccatcaatggccatgcgatgcgtgggaataggcaacagagacttcgttgaaggactgtcaggagcaacgtgggtggatgtggtactggagcatggaagctgcgtcaccaccatggcaaaaaataaaccaacattggacattgaactcttgaagacggaggtcacgaaccctgccgtcttgcgcaaactgtgcattgaagctaaaatatcaaacaccactaccgattcaagatgcccaacacaaggagaagctacactggtggaagaacaagacgcgaactttgtgtgtcgacgaacattcgtggacagaggctggggtaatggttgtggactattcgggaaaggaagcttactgacgtgtgctaagtttaagtgtgtgacaaaacttgaaggaaagatagttcaatatgaaaacttaaaatattcggtgatagtcactgtccacactggggaccagcaccaggtgggaaatgagaccacagaacatggaacaattgcaaccataacacctcaagctcccacgtcggaaatacagctgactgactacggagccctcacattggactgctcacctagaacagggctggacttcaatgagatggtgctgttgacaatgaaagaaaaatcatggcttgtccacaaacaatggtttttagacttgccactgccttggacctcgggggcttcaacatctcaagagacttggaacagacaagatttgctggttacatttaagacagctcatgcgaagaagcaggaagtagtcgtactggggtcacaagaaggagcaatgcacactgcgttgactggggcgacagaaatccagacgtcaggaacgacgacaatcttcgcaggacacctgaaatgtagactaaaaatggataaactgactttaaaaggggtgtcatatgtgatgtgcacaggctcatttaagttagagaaggaagtggctgagacccagcatggaaccgtcctagtgcaggttaaatacgaaggaacagatgcaccatgcaagattcccttttcaacccaagatgagaaaggagtgacccagaatgggagattgataacagccaatcccatagttactgacaaagaaaaaccagtcaacattgagacagaaccaccttttggtgagagctacatcgtgataggggcgggtgaaaaagctttgaaactaagctggttcaagaaaggaagcagcatagggaaaatgttcgaagctaccgcccgaggagcccgaaggatggctatcctgggagacacagcatgggacttcggttccataggaggggtgttcacatctgtgggaaaattggtacaccaggtttttggaaccgcatatggggtcttgttcagcggtgtttcttggaccatgaaaataggaatagggatcctgctgacatggctaggattaaattcaaggagcacgtcactctcgatgacgtgcattgtagttggcatggtcacactgtacctaggagtcatggttcaagcggactcggggtgtgtaatcaactggaagggcagagaactcaaatgcggaagtggcatcttcgtcactaatgaagtccacacttggacagagcaatataaattccaggctgactccccaaaaagactgtcagcagccattgggaaggcatgggaggaaggcgtgtgtggaattcgatcagccacacgtcttgagaacatcatgtggaagcaaatatcaaatgaattgaaccacattctacttgaaaatgacatgaaattcacagtggttgtaggagacgctaatggaatcttgacccaaggaaaaaagatgattaggccacaacccatggaacacaaatactcatggaaaagctggggaaaagccaaaatcataggagcagatatacagaacaccaccttcatcattgatggcccagacactccagaatgccccgatgaccagagagcatggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgagacctggaagctagcgagagcctccttcatagaagtgaagacatgcatctggccaagatcccacactctatggagcaatggagtcttggaaagtgaaatgataatcccaaagatatatggaggaccaatatctcagcacaactacagaccagggtatttcacacaaacagcagggccatggcacctaggcaagttggaactagactttgatttgtgtgaaggcaccacagttgttgtggatgaacattgtggaaatcgaggtccttctcttagaactacaacagtcacaggaaagataatccatgaatggtgttgcagatcctgcacgctaccccccttacgcttcaaaggagaagacggatgttggtatggcatggaaatcagaccagttaaagagaaggaagagaatctagtcaggtcaatggtctctgcagggtcaggagaagtggacagtttttcattgggactactatgcgtatcaataatggttgaagaagtgatgagatccagatggagtagaaagatgctgatgactggaacactggctgttttcttccttcttataatgggacaactgacatggaatgatctgatcaggttatgcatcatggttggagccaatgtctcagacaggatggggatgggaacaacgtacctagccttgatggccactttcaaaatgagaccgatgttcgctgttgggctattatttcgcagactaacatccagagaggttctccttctcacaattggactaagcctggtggcatccgtggagctaccaaattctttagaggagctaggggacggacttgcaatgggcatcatgatgttaaaattgttgaccgattttcagtcacaccagttatggactaccttactgtctctgacatttatcaaaacaactctttcattggattatgcatggaagacaatagctatggtattgtcaatcgtatctctctttcctttatgtctatctacgacctctcaaaaaacaacatggcttccggtgctgttaggatcttttggatgcaaaccactaaccatgtttcttataacagaaaacaaaatctggggaaggaaaagttggcccctcaatgaaggaattatggctgttggaatagtcagtattctactaagttcactcctcaaaaatgatgtgccactagccggcccactaatagctggaggcatgctaataacatgttatgtcatatccggaagctcagccgatttatcattggagaaagcggctgaggtttcctgggaagaagaagcagaacactctggtgcctcacacaatatactagtggaggtccaagatgatggaactatgaaaataaaagatgaagagagagatgacacgctcaccatactccttaaagcaactctgttggcagtctcaggggtgtacccaatgtcaataccagcaaccctttttgtgtggtatttttggcagaaaaagaaacagagatcaggagtcttgtgggacacacctagccctccagaagtggaaagagcagttcttgatgatggtatctatagaatcttgcaaagaggactgttgggtaggtcccaggtaggagtgggagtttttcaagacggcgtgttccacacaatgtggcatgtcaccaggggggctgtcctcatgtaccaagggaagaggctggaaccaagttgggccagtgtcaaaaaagacttgatctcatatggaggaggttggaggtttcaaggatcatggaacacgggagaagaagtacaggtgatagctgttgaaccaggaaaaaacccaaaaaatgtacagacaacgccgggcaccttcaagacccctgaaggcgaagttggagccatagccctagatttcaaacccggcacatctggatctcccatcgtgaacagagagggaaaaatagtaggtctttatggaaatggagtggtgacaacaagtggaacttacgtcagtgccatcgcccaagccaaagcatcacaagaagggcctctaccagagattgaggacgaggtgtttaagaaaagaaacctaacaataatggacctacatccaggatcaggaaaaacaagaagatatcttccagccatagtccgtgaggccataaaaaggaaactgcgcacgctaatcttggctcccacaagagttgtcgcctctgaaatggcagaggcgcttaaaggaatgccaataagatatcagacaacagcagtaaagagtgaacacacaggaagggagatagttgatctcatgtgccacgccactttcaccatgcgtctcctatctccagtgagagttcccaattacaacatgattatcatggatgaagcacactttaccgatccagccagcatagcggccagagggtacatctcaacccgagtgggtatgggtgaagcagctgcgatctttatgacagccactcccccaggatcggtagaggcctttccacagagcaatgcagttatccaagatgaggaaagagacattcctgagagatcatggaactcaggctacgactggatcactgatttcccaggaaaaacagtctggtttgttccaagcatcaaatcaggaaatgacattgccaactgtttaagaaagaacgggaaacgggtgatccaattgagcagaaaaacctttgacactgaataccagaaaacaaaaaacaatgactgggactatgttgtcacaacagacatttccgaaatgggagcaaatttccgggctgacagggtaatagacccaaggcggtgcttgaagccggtaatactaaaagatggcccagagcgcgtcattctagctggaccaatgccagtgaccgtggccagtgctgcccagaggagaggaagaattggaaggaaccaaaacaaggaaggtgaccagtatatttacatgggacagcctttaaataatgatgaggaccacgctcattggacagaagcaaaaatgctccttgacaatataaacacgccagaagggattatcccagccctctttgagccggagagagaaaagagtgcagcaatagacggggagtacagactgcggggagaagcaaggaaaacgttcgtggagttaatgagaagaggggatctaccagtttggctatcttacaaagttgcctcagaaggcttccagtactccgacagaaggtggtgctttgacggggaaaggaacaaccaggtgttggaggagaacatggacgtggagatctggacaaaagaaggagaaagaaagaaattacgacctcgctggttagatgccagaacctactctgatccactggccctgcgcgagtttaaagagttcgcagcaggaagaagaagtgtctcaggtgacctaatattagaaatagggaaacttccacagcatttgacgctaagggcccagaatgctttggacaacttggtcatgttgcacaattccgaacaagggggaaaagcttatagacatgctatggaagaattaccagacaccatagaaacattgatgctcctagctttgatagctgtgctgactggtggagtgacgttgtttttcctatcaggaaaaggtctagggaaaacatccattggcctactttgtgtgatggcctcaagtgtactgttatggatggccagtgtggagccccattggatagcggcctccatcatactagagttctttctgatggtgctgctcattccagagccagacagacagcgtactccacaggacaatcagctagcatatgtggtgataggtttgttattcatgatattgacagtggcggccaatgagatgggattactggaaaccacaaagaaagacctggggattggccatgcagtcgccgaaaaccaccaccatgcaacaatgctagacatagacctacatccagcttcagcctggaccctctatgcagtagccacaacaattatcactcccatgatgagacacacaattgaaaacacaacggcaaatatttccctgacagctattgcaaatcaggcggctatattgatgggacttgacaagggatggccaatatcgaagatggacataggagtgccacttctcgctttagggtgctattcccaggtgaacccattgacactgacagcagcggtgttgatgttagtggctcattatgccataatcggacctggactgcaagcaaaagccactagagaagcccaaaaaaggacagcggccggaataatgaaaaatccaactgtagacgggattgttgcaatagatttggatcctgtggtttatgatgcaaaatttgaaaaacagctaggccaaataatgttactgatactttgtacatcacagattctcttgatgcggactacatgggccttatgtgaatccatcacactggctactggacccttgaccactctctgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagaaaaatggaaaagacaactaaaccaactgagcaagtcagaatttaacacttacaaaaggagtggaattatggaggtggacagatctgaagccaaggagggactgaaaagaggagaaacaaccaaacatgcagtgtcgagaggaacagccaaacttaggtggtttgtggagaggaaccttgtgaaaccagaagggaaagtgatagacctcggttgtggaagaggtggctggtcatattattgcgctgggctgaagaaggttacagaagtgaagggatacacaaaaggaggacccggtcatgaggaacctatcccaatggcgacttatggatggaacctagtgaagctacactccggaaaagatgtattctttacaccacctgagaaatgtgacacccttttgtgtgacattggtgagtcctctccgaatccaaccatagaagaaggaagaacgttacgtgttctaaagatggtggaaccatggctcagaggaaatcagttttgcataaaaatcctaaatccttacatgccaagtgtggtagaaactctggagcaaatgcaaagaaaacatggagggatgctagtgcgaaacccactctcaagaaattctacccatgaaatgtactgggtttcatgtggaacaggaaacatcgtgtcggcagtgaacatgacatctagaatgttgctgaatcggttcacaatggctcacaggaagccaacgtatgaaagagacgtggacttgggcgctggaacaagacatgtggcagtggaaccagagatagccaacctagacattattggccagaggatagagaacataaaaaatgaacacaagtcaacatggcattatgatgaggacaatccatacaaaacatgggcctatcatggatcatatgaggtcaagccatcagggtcagcctcatccatggtgaatggcgtggtgagattgctcaccaaaccatgggatgttatccccatggtcacacaaatagctatgactgataccacacccttcggacaacagagggtgtttaaagagaaagttgacacacgcacaccaagaccaaaacgaggcacagcacaaattatggaggtgacagccaagtggttgtggggtttcctctctagaaacaaaaaacccagaatctgcacaagagaggagttcacaagaaaagtcaggtcaaacgcagcaattggagcagtgttcgttgatgaaaaccaatggaactcagcaaaagaagcagtggaagacgaaaggttttgggacctcgtgcatagagagagggagcttcataaacagggaaaatgcgccacatgtgtctacaatatgatggggaaaagagagaaaaaattaggagagtttggaaaggcaaaaggaagtcgtgcaatatggtacatgtggttgggagcacgctttctagagtttgaagcccttggcttcatgaatgaagaccactggttcagtagagagaattcactcagtggagtggaaggagaaggactacacaaacttggatacatactcagagacatatcaaagattccagggggaaatgtgtatgcagatgacacagctggatgggacacaagaataacggaggatgatcttcagaatgaggctaaaatcactgacatcatggagcccgaacatgctctactggctacgtcaatcttcaagctgacctatcaaaataaggtggtaagggtgcaaagaccagcaaaaagtggaaccgtgatggatattatatccagacgtgaccagagaggaagtggacaggtcggaacttatggcttaaatactttcaccaacatggaggtccaactaataagacaaatggaatctgaaggaatcttttcacccagcgaattggaaaattcaaatctagctgagagagttctcgactggttggaaaaacatggcgtcgaaaggttgaaaagaatggcaatcagcggagatgactgtgtggtgaaaccaactgatgacaggttcgcaacagctttaacagccctgaatgacatgggaaaagtgagaaaagacataccacaatgggaaccttcaaaaggatggaatgactggcaacaagtgcctttctgttcacaccatttccaccaactgatcatgaaagatgggagggagatagtggtgccatgccgcaaccaagatgaacttgtgggcagggccagagtatcacaaggcgccggatggagcctgagagaaactgcttgcctaggcaagtcatatgcacaaatgtggcagctgatgtacttccacaggagagacctgagactagcggccaatgctatctgttcagccgttccagttgattgggtcccaaccagccgcaccacctggtcgatccatgcccaccaccaatggatgacaacagaagacatgttatcagtgtggaatagggtttggatagaggaaaacccatggatggaggacaaaactcatgtatccagttgggaagatgttccatacttaggaaaaagggaagatcaatggtgtggatccctgataggcttaacagcaagggccacctgggccaccaacatacaagtggccataaaacaagtgagaaggctcattgggaatgagaattatttagactacatgacatcaatgaagagattcaagaatgagagtgatcccgaaggagccctctggtaa

SEQ ID NO: 6353 - RNA, 9879 nt, synthetic construct
  misc_feature 1..9879: note = derived and/or modified CDS sequence (wt) from DENV-1__DQ285558__SS-prME
  source 1..9879: mol_type = other RNA
tctgtgaccatgctcctcatgctactgcccacagccctgacgttccatctgaccacccgagggggagagccgcacatgatagttggcaagcaggaaagaggaaagtcacttttgtttaagacctctgcaggtgtcaacatgtgtacccttattgcaatggatctgggagagttatgtgatgacacgatgacctacaaatgcccccggatcactgagacggaaccagatgacgttgactgttggtgcaatgccacggagacatgggtgacctatggaacatgttctcaaaccggtgaacaccgacgagacaaacgttccgttgcactggcaccacacgtagggcttggtctggaaacaagaaccgaaacgtggatgtcctctgaaggcgcttggagacaaatacaaaaagtggagacatgggccctgagacacccaggattcacggtgatagccctttttctagcacatgccatagggacatccatcacccagaaagggattattttcattttgctgatgctggtaactccatccatggccatgcggtgcgtgggaataggaaacagagacttcgtggaaggactgtcaggagctacgtgggtggatgtagtactggagcatggaagttgtgtcactaccatggcaaaagacaaaccaacactggacattgaactcttgaagacggaggtcacaaaccctgccgtcttgcgcaaactgtgcattgaagccaaaatatcaaataccaccactgattcgagatgtccgacacaaggagaagccacgttggtggaagaacaagacacgaactttgtgtgtcgacgaacgttcgtggacagaggctggggcaatggttgtggactattcggaaaaggtagcttaataacgtgtgctaagtttaagtgtgtgacaaaattggaaggaaagatagtccaatatgaaaacttaaaatactcagtgatcgttaccgtccacactggagaccagcaccaagttggaaatgagaccacagaacatggaacaattgcaaccataacacctcaagctcccacgtcggaaatacaactgacagactacggagctctgacactggactgttcacctagaacagggctagactttaatgagatggtgttgttgacaatgaaagaaaaatcatggctcgtccacaaacaatggtttctagacttaccactgccttggacttcaggggcttcaacatcccaagagacttggaatagacaagacttgctggtcacatttaagacagctcatgcaaagaagcaggaagtagtcgtactaggatcacaagaaggagcaatgcatactgcgttgactggagctacagaaatccaaacgtctggaacgacaacaatttttgcaggccatctgaaatgcagactaaaaatggacaaactgactctaaaaggaatatcatatgtaatgtgcacaggctcattcaagttagagaaggaagtggctgagacccagcatggaactgttctagtacaggttaaatacgaaggaacagatgcaccatgcaagatccccttctcgtctcaagatgagaagggagtaacccagaatgggagattggtaacggccaaccccatagtcactgacaaagaaaaaccagtcaatattgaggcggagccaccttttggtgagagttacatcgtggtaggagcaggagaaaaagctttgaaactaagctggttcaagaagggaagcagcatagggaaaatgtttgaagcaactgcccgtggagcacgaaggatggccatcttgggagacaccgcatgggacttcggttctataggaggagtgttcacgtctgtgggaaaactggtacaccagatttttggaactgcgtatggagtcttgttcagtggtgtctcttggaccatgaaaataggaatagggattctgctgacatggctgggattaaactcaaggagcacgtctctttcaatgacgtgtatcgcagttgggctgatcacactgtacctaggagtcatggtccaggcggactcgggatgtgtaatcaactggaaaggcagagaactcaaatgtggaagcggcatttttgtcaccaatgaagttcacacctggacagagcaatacaaatttcaggccgactccccaaagagactatcagcagccattgggaaggcatgggaggaaggtgtgtgtggaattcgatcagccacccgtctcgagaacatcatgtggaagcaaatatcaaatgaattaaaccacatcttacttgaaaatgacatgaaatttacagtggtcgtaggagacgttagtggaatcttggcccaaggaaagaaatcgattaggccacaacccatggaacataaatactcgtggaaaagctggggaaaagccaaaatcattggagcagatgttcagaacactactttcatcatcgacggcccaaacaccccagaatgccctgatgaccaaagagcatggaacatctgggaagttgaagactatggatttggaattttcacgacaaacatatggttgaaattgcgtgactcctacacccaagtgtgtgaccatcgactaatgtcagctgccatcaaggatagcaaagcagtccatgctgacatggggtactggatagaaagtgaaaagaacgagacttggaagttggcaagagcctccttcatagaagtcaagacatgcatctggccaaagtctcacactctatggagcaatggagtcctggaaagtgagatgataatcccaaagatatatggaggaccaatatctcagcataattacagaccaggatatttcacacaaacagcaggaccgtggcacttaggcaagttggaactagattttgatttgtgtgaaggtaccacagttgttgtagatgaacactgtggaaatagaggaccatctcttagaaccacaacagtcacaggaaagataatccatgaatggtgctgtagatcttgcacgttaccccccctacgtttcaaaggagaagacgggtgctggtatggcatggaaatcagaccagtcaaggagaaggaagagaacctagtcaagtcaatggtctctgcagggtcaggagaggtggacagtttttcactaggactgttgtgcatatcaataatgatcgaagaggtaatgagatccagatggagcaggaaaatgctgatgactggaacattggctgtgttcctccttctcacaatgggacaattgacatggaacgatctaatcaggctatgcatcatggttggagccaatgcttcagacaatatggggatgggaacaacgtacttagctttgatggccactttcagaatgagaccaatgttcgcagtcgggctattatttcgcagattaacatctagagaagttcttcttctcacggttggattgagtctggtggcatctgtagaactaccaaattccttagaggagctaggggatggacttgcaatgggcatcatgatattaaaattactaactgattttcaatcacatcagctatgggccaccttgctgtctctgacatttgtcaaaacaaccttttcattgcactacgcatggaagacaatggctatgatactgtcaattgtatctctcttccctttatgcctgtccacgacttctcaaaaaacaacatggcttccggtgcttctggggtctcttggatgcaaaccactaaccatgtttctcataacagaaaacaaaatctggggaaggaaaagttggcctctcaatgaaggaatcatggctgttggaatagttagcattctactaagctcacttctcaaaaatgatgtgccactagctggcccattaatagctggaggcatgctaatagcgtgttatgtcatatccggaagctcggccgatttatcactggagaaagcggctgaggtctcctgggaagaagaagcagaacactctggtgcctcacacaacatactagtggagatccaagatgatggaaccatgaagataaaagatgaagagagagatgacacgatcaccatcctcctcaaagcaaccttgctagcaatctcaggggtatacccaatgtcaataccggcgactctctttgtgtggtatttttggcagaaaaagaaacagagatcaggagtgctatgggacacaccaagccctccagaagtggaaagagcagtccttgatgatggcatttatagaattctccaaaggggattgttgggcaggtctcaagtaggagtaggagttttccaagaaggcgtattccacacaatgtggcatgtcaccaggggagctgttctcatgtaccaagggaagagattggaaccaagttgggccagtgtcaaaaaagacttgatctcatatggaggaggctggaggtttcaaggatcctggaacacgggagaagaagtgcaggtgattgctgttgaaccggggaagaacccaaaaaatgtacagacagcgccgggtaccttcaagacctctgaaggcgaagttggagccatagctctagactttaaacccggcacatctggatctcctatcgtgaacagagagggaaaaatagtaggtctttatggaaatggagtggtgacaacaagtggaacctatgtcagtgctatagctcaagctaaagcatcacaagaagggcctttgccagagattgaggacgaggtgtttaggaaaagaaacttaacaataatggacctacacccaggatcgggaaaaacaagaagataccttccagccatagtccgtgaggccataaaaagaaagctgcgcacgctagttttagctcccacaagggttgtcgcctctgaaatggcagaggcgctcaagggaatgccaataaggtatcagacaacagcagtgaagagtgaacacacgggaagggagatagttgaccttatgtgtcacgccactttcactatgcgtctcctgtctcctgtgagagttcccaattacaacatgataatcatggatgaagcacatttcaccgatccagccagcatagcagccagagggtacatctcaacccgagtgggtatgggtgaagcagctgcgattttcatgacagccactccccccggatcggtggaggcctttccacagagcaatgcagttatccaagatgaggagaaagacattcctgaaagatcatggaactcaggctatgactggatcactgatttcccaggtaaaacagtctggttcgttccaagcatcaaatcaggaaatgacattgccaactgtttaagaaaaaatgggaaacgggtgatccaattgagcagaaaaacttttgacactgagtaccagaaaacgaaaaataacgactgggactatgttgtcacaacagacatttccgaaatgggagcaaactttcgagccgacagggtaatagacccaaggcgatgcctgaaaccggtaatactgaaagatggtccagagcgtgtcattctagccggaccgatgccagtgaccgtggctagtgccgcccagaggagaggaagaattggaaggaaccaaaataaggaaggtgatcagtatatttacatgggacagcctttaaataacgatgaggaccacgcccattggacagaagcaaaaatgctccttgacaacataaacacaccagaagggatcatcccagccctctttgagccagaaagagaaaagagtgctgcaatagacggggaatacagactacggggtgaagcgaggaaaacgtttgtggagctcatgagaagaggagatctacctgtctggctatcttacaaagttgcctcagaaggcttccaatactccgacagaaggtggtgctttgatggggaaaggaacaaccaggtgttggaggagaacatggacgtggagatctggacaaaagaaggagaaagaaagaaactacgaccccgctggctggatgccagaacatactctgacccactggctctgcgcgaattcaaagagttcgcagcaggaagaagaagcgtctcaggtgacctaatattagaaatagggaaacttcctcaacatctaactcaaagggcccagaatgctttggacaatttggttatgctgcacaactctgaacaaggaggaaaagcttatagacacgccatggaagaattgccagacactatagagacgttgatgctcctagctctgatagctgtgctgactggtggagtgacgctgttcttcctatcaggaagaggcttagggaaaacatccattggcctactctgcgtgatgtcctcaagtgcactgttatggatggccagtgtggagccccattggatagcggcctctatcatactggagttctttctgatggtgttgcttattccggagccagacagacagcgcactccacaagacaaccagttagcatatgtggtgataggtttgttattcatgatattgacagtggcagccaatgagatgggattattagaaaccacaaagaaagacctggggattggtcatgcagctgctgaaaaccaccaccacgccgcaatgctggacgtagacctacatccagcttcagcctggactctctacgcagtggccacaacgattatcactcccatgatgagacacacaattgaaaacacaacggcaaacatttccctgacagccattgcaaaccaggcagctatattgatgggacttgataagggatggccaatatcaaagatggacataggagttccacttctcgccttggggtgctattctcaggtgaacccgctgacgctgacagcggcggtactgatgctagtggctcattatgccataattggaccaggactgcaagcaaaagccactagagaagctcaaaaaagaacagcagccggaataatgaaaaacccaactgtcgacgggatcgttgcaatagatttagaccctgtggtttatgatgcaaaatttgaaaaacagctaggccaaataatgttgttgatactatgcacatctcagattctcttgatgcggaccacatgggccttgtgtgaatccatcacactggccacaggacctctgaccacgctttgggagggatctccaggaaaattctggaacaccacgatagcggtgtccatggcaaacatttttagggggagttatctagcaggagcgggtctggccttttcattaatgaaatctctaggaggaggtaggagagggacgggagcccaaggagaaacactgggagaaaagtggaaaagacagctaaaccaattgagcaagtcagaatttaacatttacaagaggagtggtattgtagaggtggatagatctgaagccaaggaggggttaaaaagaggagaaacaatcaaacacgcagtgtcgagaggaacggccaaactgaggtggtttgtggagaggaaccttgtgaaaccagaagggaaagtcatagacctcggctgtggaagaggtggctggtcatattactgcgctgggctgaagaaagtcacagaagtgaaaggatacacaaaaggaggacctggacatgaggaaccaatcccaatggcaacctatggatggaacctagtaaagctatactccgggaaagatgtattctttataccacctgagaaatgtgacacccttttgtgtgatattggtgagtcctctccgaacccgactatagaagaaggaagaacgttgcgtgttctaaagatggtagaaccatggctcagaggaaaccaattttgcataaagattctaaatccctacatgccgagtgtggtagaaactctggagcaaatgcaaagaaaacatggaggaatgctagtgcgaaatccactctcaagaaactccactcatgaaatgtactgggtttcatgtggaacaggaaacattgtgtcagcagtaaatatgacatctagaatgctgctgaatcgattcacgatggctcacaggaagccaacatatgaaagagatgtggacttgggcgctggaacgagacatgtggcagtagaaccagaggtggccaacctagacatcattggccagaggatagagaatataaaaaatgaacacaaatcaacatggcattatgatgaggacaacccgtacaaaacatgggcctatcatggatcatatgaggtcaagccatcaggatcagcctcatccatggtcaatggtgtggtgagactgctaaccaaaccatgggatgtcattcccatggtcacacaaatagccatgactgataccacaccctttggacaacaaagggtgtttaaagagaaagttgacacgcgtacaccaaaagcgaaacgaggcacagcacaaattatggaggtgacagccaagtggttatggggttttctctccagaaacaaaaaacccagaatctgcacaagagaggagttcacaagaaaagtcaggtcaaatgcagctattggagcggtgttcgttgatgaaaatcaatggaactcagcaaaagaggcagtggaagatgaaaggttctgggatcttgtgcgcagagagagggagcttcataaacaaggaaaatgtgccacgtgtgtctacaacatgatgggaaagagagagaaaaaattaggagagttcggaaaggccaaaggaagtcgcgcaatatggtatatgtggttgggagcgcgcttcttagagtttgaagccctcggcttcatgaatgaagatcactggttcagcagagagaattcactcagtggagtggaaggagaaggactccacaaacttggatacatactcagagacatatcaaagattccagggggaaacatgtatgcagatgatacagccggatgggacacaagaataacagaggatgatcttcagaatgaggccaaaatcactgacatcatggaacctgaacacgccctactggccacgtcaatctttaagttaacctaccaaaacaaggttgtaagagtgcagagaccagcaaaaaatggaaccgtgatggatgtcatatccaggcgtgaccagagaggaagtggacaggttggaacttatggcttaaacaccttcaccaacatgggggcccaactaataagacaaatggagtctgagggaatcttttcacccagtgaattggaaaccccaaatttagctggaagagtccttgactggttggaaaaacatggcatcgagaggctgagaagaatggcaatcagtggagatgactgcgtggtgaaaccaattgatgacagatttgcaacagccttaacagccttgaatgatatgggaaaggtaagaaaagacataccgcaatgggaaccttcaaaaggatggaatgattggcaacaagtgcctttctgctcacaccacttccaccagctgattatgaaggatggaagggaaatagtagtgccatgccgcaaccaagatgaactggtaggtagggccagagtatcacaaggtgccggatggagcttgagagaaactgcatgtctaggcaagtcgtatgcacaaatgtggcagctgatgtacttccacaggagagacttgagattagcggctaatgctatttgttcagccgttccagttgattgggtcccaaccagtcgcaccacctggtcgatccatgcccaccatcaatggatgacaacagaagacatgttgtcagtgtggaatagggtttggatagaggaaaacccatggatggaggataaaactcacgtgtccagctgggaagacgttccatacctagggaaaagggaagatcaatggtgtggatccctaataggcttaacagcacgagccacctgggccaccaacatacaagtggccataaaccaagtgagaaggctcattgggaatgagaattacctagactacatgacatcaatgaagagattcaaaaacgagagtgatcccgaaggggcactctggtaa

SEQ ID NO: 6354 - RNA, 9879 nt, synthetic construct
  misc_feature 1..9879: note = derived and/or modified CDS sequence (wt) from DENV-1__DQ285559__SS-prME
  source 1..9879: mol_type = other RNA
tccgtgactatgctcctcatgctgctgcccactgccctgacattccatttgaccacacgagggggagagccacacatgatagttagcaagcaggaaagaggaaagtcactcttgtttaagacctctgtaggtgtcaatatgtgcactctcattgcgatggatttgggagagttatgtgaggacacaatgacctacaaatgcccccggatcactgaggcggaaccagatgatgttgactgttggtgcaatgccacagacacatgggtgacctatgggacgtgttctcaaaccggcgaacaccgacgagacaaacgttccgtcgcactggccccacatgtgggacttggtctggaaacaagaaccgaaacgtggatgtcctctgaaggcgcctggaaacaaatacaaaaagtggagacttgggctttgcgacacccaggatttacggtgatagcccttttcttggcacatgccataggaacatccatcactcagaaagggatcattttcattctgctgatgctggtaacaccatcaatggccatgcgatgcgtgggaataggcaatagagactttgttgaaggactgtcaggagcaacgtgggtggatgtagtactggagcatggaagctgcgtcaccaccatggcaaaaaataaaccaacactggacattgaacttctgaaaacggaggtcacgaaccctgccgtcctgcgcaaactgtgcattgaagctaaaatatcaaacaccaccaccgattcaagatgtccaacacaaggagaagctacactggtggaagaacaagatgcgaactttgtgtgtcgacgaacgttcgtggacagaggctggggtaatggctgcggactatttggaaaaggaagcctactgacgtgtgctaagttcaagtgtgtgacaaaactagaaggaaagatagttcaatatgaaaacttaaaatattcagtgatagtcactgtccacactggggaccagcaccaggtgggaaacgagactacagaacatggaacaattgcaaccataacacctcaagctcctacgtcggaaatacagctgatcgactacggagccctcacattggattgctcacctagaactgggctggactttaatgagatggtgctattgacaatgaaaggaaaatcatggcttgtccacaaacaatggtttctagacttaccactgccttggacttcgggggcttcaacatcccaagagacttggaacagacaggatttgctggtcacattcaagacagctcatgcaaagaagcaggaagttgtcgtactgggatcacaggaaggagcaatgcacactgcgttgactggggcgacagaaatccagacgtcaggaacgacaacaatctttgcaggacacctgaaatgcagactaaaaatggataaactgactttaaaagggatgtcatatgtgatgtgcacaggctcatttaagctagagaaggaagtggctgagacccagcatggaactgtcttagtgcaggttaaatacgaaggaacagatgcaccatgcaagatccccttttcgacccaagatgagaaaggagtgacccagaatgggagattgataacagccaatcctatagttactgacaaagaaaaaccagttaacattgagacagaaccaccatttggtgagagctacatcgtggtaggggcaggtgaaaaagctttgaaactaagttggttcaagaaaggaagcagcatagggaaaatgttcgaagcaaccgcccgaggagcacgaaggatggctatcctgggagacaccgcatgggacttcggttccataggaggagtgttcacgtctgtgggaaaattgacacatcaggtttttggaaccgcatatggggttctgttcagcggtgtttcttggaccatgaaaataggaatagggattctgctgacatggttgggattaaattcaaggagcacgtcactttcgatgacgtgcattgcagttggcatggtcacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaaaactgtcagcagccattggaaaggcatgggaggagggcgtgtgtggaattcgatcagccacgcgtcttgagaacatcatgtggaagcaaatatcaaatgaattgaactacatcttacttgaaaatgacatgaaattcacagtggttgtaggagatgccaatggaattttggcccaagggaaaaaaatgattagaccacaacccatggaacacaaatattcatggaaaagctggggaaaagccaaaatcataggagcagacatacagaacaccactttcattattgacggcccagatactccagaatgtcccgatgaccagagagcatggaacatttgggaagttgaggactatggattcggaattttcacgacaaacatatggctgaaattgcgtgactcctatacccaaatgtgtgaccaccggctaatgtcagctgccatcaaggacagcaaggcagtccatgctgatatggggtactggatagaaagtgaaaagaacgagacctggaagctagcgagagcctcctttatagaagtcaagacatgcatctggccgaaatcccacactctatggagtaatggagtcttggaaagtgaaatgataattccaaagatatatggaggaccaatatctcagcacaactacagaccagggtatttcacacaaacagcagggccatggcacctaggcaagttggaattggattttgatttgtgtgaaggtaccacagttgttgtggatgaacattgtggaaatcgaggtccatctctcagaactacaacagtcacaggaaagataatccatgaatggtgttgcagatcctgcacgttaccccccttacgcttcagaggagaagacggatgttggtatggtatggaaatcagaccagttaaggagaaggaggagaatctagttaggtcaatggtctctgcagggtcaggagaagtggacagtttttcattaggaatactatgcgtatcaatactaattgaagaagtgatgagatccaaatggagtagaaagatgctgatgactggaacactggctgttttcctccttcttataatgggacaactgacatggaatgatttgaccaggttatgcatcatggttggagccaatgcttcagacaggatggggatgggaacaacatacctagccttgatggctactttcaaaatgagaccaatgtttgctgttgggctattatttcgtagactaacatccagagaagttcttcttctcacgattggattaagcctggtggcatccgtggagctaccaaattctttagaggagctaggggatggactcgcaatgggcatcatgatattaaaattattgactgattttcagccacaccagttatggaccaccttactgtctttaacatttatcaaaacgactctttcattggattatgcatggaagacaatggccatgacactgtcaattgtatctctctttcctttgtgtctgtctacgacctcccaaaaaacaacatggcttccggtgctgttaggatcctttggatgtaaaccattaaccatgtttcttataacagaaaacaaaatctggggaaggaaaagttggcccatcaatgaaggaatcatggctgttggaatagtcagcattctactaagttcactcctcaaaaatgatgtgccgctagccggcccactaatagctggaggcatgttaatagcatgttatgtcatatccggaagctcagccgatctatcattggagaaagcggctgaggtgtcctgggaagaagaagcagaacactctggtacctcacacaacatattggtggaggttcaagatgatggaaccatgaaaataaaagatgaagagagggatgacacactcaccatactccttaaagcaactctgctggcagtctcaggagtgtacccaatgtcaataccagcaactctttttgtgtggtatttttggcagaaaaagaaacagagatcaggagtgttatgggacacacccagccctccggaagtggaaagagcagttcttgatgatggcatttatagaatcttgcagagaggactgttggggaggtcccaagtaggagtgggagttttccaagacggcgtgttccacacaatgtggcacgtcaccaggggagctgtccttatgtaccaagggaagaggctggaaccaagctgggctagtgtcaaaaaagacttgatctcatatggaggaggttggaggtttcaaggatcatggaacacaggagaagaagtgcaagtgatagctgttgaaccaggaaaaaaccccaaaaatgtacagacaacgccgggtaccttcaagactcctgaaggcgaagttggagccatagctctagacttcaaacccggcacatctggatctcccatcgtgaacagagagggaaaaatagtaggtctttatggaaatggagtggtgacaacaagtggaacctacgtcagtgccatcgctcaagccaaagcatcgcaagaagggcctctaccagagattgaggacgaggtgtttaagaaaagaaacttaacaataatggacctgcatccaggatcaggaaaaacaagaagatatcttccagccatagtccgtgaggccataaaaaggaagctgcgcacgctaatcttggctcccacaagagttgtcgcctctgaaatggcagaggcgctcaagggaatgccaataagatatcagacaacagcagtgaagagtgaacatacaggaagggagatagttgacctcatgtgccacgccacttttaccatgcgtctcttatctccagtgagagttcccaattacaacatgattatcatggatgaagcacattttaccgatccagccagcatagcggccagagggtacatctcaacccgagtgggtatgggtgaagcagctgcgatcttcatgacagccacacccccaggatcggtggaggcctttccacagagtaatgcagttatccaagacgaggaaaaagacattcctgagagatcatggaactcaggctacgactggatcactgattttccaggtaaaacagtttggtttgtcccaagcatcaaatcaggaaatgatattgccaactgtttaagaaagaacggaaaacgggtgattcaactgagcaggaaaacatttgacactgagtaccagaaaacaaaaaacaatgactgggactatgttgtcacaacagacatttccgaaatgggagcaaatttccgagccgatagggtgatagatccaaggcggtgcttgaaaccggtaatactaaaagatggtccagagcgcgtcattctagccggaccaatgccagtgactgtggccagtgctgcccagaggagaggaagaattggaaggaatcaaaacaaagaaggtgatcagtacgtttacatgggacagcctttaaataatgatgaggatcacgcccactggacagaagcaaaaatgctcctcgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcttacaaagtcgcctcagaaggtttccaatattccgacagaagatggtgttttgatggggaaaggaacaaccaggtgttggaggagaacatggacgtggagatctggacaaaggaaggagaaagaaagaaattgcgaccccgctggttggatgctagaacttactctgatccattggccctgcgcgagtttaaagagtttgcagcaggaagaagaagtgtctcaggtgacctaatattggaaataggaaaacttccacaacatttgacgctaagagcccagaatgctttggataatttggtcatgttgcacaattccgaacaaggaggaaaagcctacagacatgctatggaggaactaccagacaccatagaaacattgatgctcctagctttgatagctgtgctgactggtggagtgacgctgttcttcctatcaggaaaaggtctaggaaaaacatccattggcctactctgtgtgatggcctcaagcgcactgttatggatggccagtgtggagccccattggatagcggcctccatcatactagagttctttctgatggtgctgctcattccagagccagacagacagcgcaccccacaggacaaccagttagcatatgtggtgataggcttgttattcatgatactcacagtggcagccaacgagatgggattgttggaaaccacaaagaaagacctggggattggccacgtagccgccgaaaaccaccaccatgctacaatgttggacgtagacctacgtccagcttcagcctggaccctctatgcagtagccacaacagttatcacccccatgatgaggcacacaattgaaaatacaacggcaaatatttccctgacagccattgcaaatcaggcagccatattgatgggacttgacaagggatggccaatatcgaagatggacataggagttccacttcttgccttagggtgctattcccaggtgaacccattgacactgacagcagcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggtcaaataatgttactgatactttgtacatcacagattctcttgatgcggaccacatgggctttgtgtgaatccatcacactggctactggacccttgaccactctttgggagggatctccaggaaaattctggaacaccacgatagcagtgtccatggcaaacatcttcaggggaagttatctagcaggagcaggtctggccttctcattgatgaaatctttaggaggaggtaggagaggcacgggagctcaaggggaaacactgggagaaaaatggaaaagacagctaaaccaactgagcaagtcagaatttaacacctacaaaaggagtgggattatggaggtggacagatccgaagccaaagagggattgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgcgctgggctgaagaaagtcactgaagtgaagggatatacaaaaggaggacctggacatgaggaacctatcccaatggcgacctatggatggaacctagtaaagctgcactctggaaaagatgtgttcttcataccgcctgagaaatgtgacacccttttgtgtgatatcggtgagtcctctccgaatccaactatagaagaaggaagaacgttacgtgttctaaagatggtggaaccatggctcaaaggaaaccaattctgcataaagatcctgaatccttacatgccaagtgtggtagaaactctggagcaaatgcaaagaaaacatggagggatgctggtgcgaaacccactctcaagaaattccacccatgaaatgtactgggtttcatgtggaacaggaaacattgtgtcggcagtgaacatgacatccagaatgttactgaaccgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcttatcatggatcgtatgaggtcaagccatcaggatcagcctcatccatggtgaatggcgtggtgagattgctcaccaaaccatgggatgttatccctatggtcacacaaatagccatgactgataccacaccattcggacaacagagggtgtttaaagagaaagttgacacgcgcacaccaagagcaaaacgaggcacagcacaaattatggaggtgacagccaagtggttatggggtttcctttccagaaacaaaaaacccagaatctgcacaagagaggagttcacaagaaaagtcaggtcaaacgcagcaataggagcagtgttcgttgatgaaaaccaatggaactcagcaaaagaagcagtggaagacgaaaggttttgggatctcgtacacagagagagggagcttcataaacagggaaaatgtgccacgtgtgtttacaacatgatggggaagagagagaaaaaattaggagagtttggaaaagcaaaaggaagccgtgcaatatggtacatgtggctgggagcacgctttctagaatttgaagcccttggtttcatgaatgaagatcactggttcagtagagagaattcactcagtggagtggaaggagaaggactgcacaaacttggatacatactcagagacatatcaaagattccggggggaaatatgtatgcagatgacacagccggatgggacacaagaataacagaggatgatcttcagaatgaggctaaaatcactgacatcatggagcctgaacatgctctattggctacagcaatttttaaactgacctaccaaaataaggtggtgagggtgcaaagaccagcaaaaagtggaaccgtaatggatgtcatatccagacgtgaccagagaggaagtggacaggtcggaacttatggcttaaacactttcaccaatatggaggctcaattaataagacaaatggagtctgaaggaatcttcctacccagcgaattggaaacccccaatctagctaagagagttcttgactggttggaaaaatatggcgccgaaaggctgaaaagaatggcaattagcggagatgattgtgtggtgaaaccaattgatgacaggttcgcaaaggccttaacagctctgaatgatatgggaaaagtaagaaaagacataccgcagtgggaaccttcaaaaggatggaatgactggcagcaagtgcctttctgttcacaccacttccaccagctgatcatgaaagatgggagggaaatagtggtgccatgccgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgactgggtcccaaccagccgcactacctggtcgatccatgcccaccaccaatggatgacaacagaagacatgttatcagtgtggaatagggtttggatagaggaaaacccatggatggaggacaaaactcatgtatccagttgggaagaggttccatacttagggaaaagggaagatcaatggtgtggatccctgataggcttgacagcgagggccacctgggccaccaacatacaagtagccataaaccaggtgagaaggctcatcgggaatgagaattatctagattacatggcatcgatgaagagattcaagaatgagagtgatcccgaaggggcgctctggtag

SEQ ID NO: 6355 - RNA, 9879 nt, synthetic construct
  misc_feature 1..9879: note = derived and/or modified CDS sequence (wt) from DENV-1__AF311956__SS-prME
  source 1..9879: mol_type = other RNA
tccgtgaccatgctcctcatgctgctgcccacagccctggctttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgttggtgcaatgccacagacacatgggtgacctatgggacgtgttctcaaaccggcgaacaccgacgagacaaacgttccgtggcactggccccacacgtgggactcggtctagaaacaagaaccgaaacatggatgtcctctgaaggcgcctggaaacaaatacaaaaagtggagacttgggctttgagacacccaggattcacggtgatagccctttttttagcacatgccataggaacatccatcactcagaaagggatcattttcattctgctgatgctggtgacaccatcaatggccatgcgatgcgtgggaataggcaacagagacttcgttgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagtctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggagccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacttgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatgggagattgataacagccaatcccatagttactgacaaagaaaaaccagtcaacatcgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatccgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaagctgactccccaaaaagactgtcagcagccattggaagggcatgggaggagggcgtgtgtggaattcgatcagccacgcgtcttgagaacatcatgtggaagcaaatatcaaatgaattgaaccacattctacttgaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtacggaggaccaatatctcagcacaactacagaccagggtatttcacacaaacagcagggccatggcacctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttcttataacagaaaacgaaatctggggaagaaaaagttggcccctcaatgaaggaattatggctattggaatagtcagcattctactaagttcactcctcaaaaatgatgtgccgttggccggcccactcatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagaaagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctacagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtaaaaaaggacttgatctcatatggaggaggttggaggtttcaaggatcatggaacacgggagaagaagtgcaggtgatagctgttgaaccagggaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgcacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgtctaagaaagaacggaaaacgggtaatccaattgagcagaaaaacctttgacactgagtaccagaaaacaaaaaacaatgactgggactatgttgtcacaacagacatttccgaaatgggggcaaatttccgggccgacagggtaatagacccaaggcggtgcttgaaaccggtaatactaaaagatggcccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatttaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattcctgagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatactggacgtagacctacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcctgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacactgggagagaaatggaaaagacagttaaaccaactgagcaagtcagaattcaacacctacaaaaggagtgggattatggaggtggacagatccgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaagtagccaacctagatatcattggccagaggatagagaatataaaaaatgaacacaagtcaacatggcattatgatgaggacaatccatacaaaacatgggcctatcatggatcatatgaggttaagccatcaggatcagcctcatctatggtgaatggagtggtgagattgctcacaaaaccatgggatgtcatccccatggtcacacaaatagctatgactgataccacaccctttggacaacagagagtgtttaaagagaaggttgacacgcgcacaccaagagcaaaacgaggcacagcacaaattatggaggtgacagccaagtggttatggggattcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcacaaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgactgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgccgcaaccaagatgaacttgtgggcagggctagagtatcacaaggcgctggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 6356 - RNA, 9879 nt, synthetic construct
  misc_feature 1..9879: note = derived and/or modified CDS sequence (wt) from DENV-1__AF311958__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgttaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattctgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggaaccctcacattggactgctcacctagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatggtagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgcgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatctcacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtggacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggactcgcaatgggtatcatgatgttaaaattattgactgaatttcagccacaccagttatggaccaccttactgtctctgacatttatcaaaacaactctttcattggattacgcatggaagacaacggctatggtactgtcaatcgtatctctctttcctttatgcctgtctacgacctctcaaaaaacaacatggcttccggtgctgttaggatcttttggatgcaaaccattaaccatgtttctcataacagaatacgaaatctggggaagaaaaagttggcccctcaatgaaggaattatggctattggaatagtcagcattctactaagttcactcctcaaaaatgatgtgccgttggccggcccactaatagctggaggcatgctaatagcatgttatgtcatatccggaagctcagccgatctatcattggagaaagcggctgaggtatcctgggaagaagaagcagaacactccggtacctcacacaacatattagtagaggtccaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtgggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcccgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagccaaagcatcacaggaagagcctctaccagagattgaggacgaggtgtttaagaaaagaaacttaacaataatggaccttcatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccatgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcaggaaaacctttgacactgagtaccagaaaacaaaaaacaatgactgggactatgttgtcacaacagacatttctgaaatgggggcaaatttccgggctgacagggtaatagacccaaggcggtgcttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctttttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaggtgacctaatattggaaatagggaaacttccacaacatttgacgctaagagcccagaatgctctggacaacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcgttaatgaaatctttaggaggaggtaggagaggtacgggagctcaaggggaaacattaggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggagcagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttatgccacctgagaaatgtgacacccttctgtgtgatattggtgagtcctctccgaatccaactatagaagaaggtagaacgttacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaaggaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccagggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgtcgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtaa

SEQ ID NO: 6357 - RNA, 9879 nt, synthetic construct
  misc_feature 1..9879: note = derived and/or modified CDS sequence (wt) from DENV-1__AF311957__SS-prME
  source 1..9879: mol_type = other RNA
tccgtgaccatgctcctcatgctgctgcccacagccctggcgttccatttgaccacacgagggggagagccacacatgatagttagtaagcaggaaagaggaaagtcactcttgttcaagacctctgcaggtgtcaatatgtgcactctcattgcgatggatttgggagagttatgtgaggacacaatgacctacaaatgcccccggatcactgaggcggaaccagatgacgttgactgctggtgcaatgccacagacacatgggtgacctatgggacgtgttctcaaaccggcgaacaccgacgagacaaacgttccgtggcactggccccacacgtgggactcggtctagaaacaagaaccgaaacatggatgtcttctgaaggcgcctggaaacaaatacaaaaagtggagacttgggctttgagacacccaggattcacggtgatagccctttttttagcacatgccataggaacatccatcactcagaaagggatcattttcattttgctgatgctggtgacaccatcaatggccatgcgatgcgtgggaataggcaacagagacttcgtcgaaggactgtcaggagcaacgtgggtagacgtggtattggagcatggaagctgcgtcaccaccatggcaaaaaataaaccaacattggacattgaactcttgaagacggaggtcacgaaccctgccgtcttgcgcaaactgtgcattgaagccaaaatatcaaacaccaccaccgattcaagatgtccaacacaaggagaggctacactggtggaagaacaagacgcgaactttgtgtgtcgccgaacgtttgtggacagaggctggggtaatggctgcggattattcggaaaaggaagcctattgacgtgtgccaagttcaagtgtgtgacaaaactagaaggaaagatagttcaatatgaaaacttaaaatattcagtgatagtcaccgtccacactggggatcagcaccaggtgggaaacgagactacagaacatggaacaattgcaaccataacacctcaagctcctacgtcggaaatacagttgactgactacggagccctcacattggactgctcacccagaacagggctggactttaatgagatggtgctattgacaatgaaagaaaaatcatggcttgtccacaaacaatggtttctagacttaccactgccttggacttcgggggcttcaacatcccaagagacttggaacagacaagatttgctggtcacattcaagacagctcatgcaaagaaacaggaagtagtcgtactgggatcacaagaaggagcaatgcacaccgcgttgactggggcgacagaaatccagacgtcaggaacgacaacaatctttgcagggcacctgaaatgcagactaaaaatggataaactgactttaaaggggacgtcatatgtgatgtgcacaggctcatttaagctagagaaggaagtggctgagacccagcatgggactgttctagtgcaggtcaaatacgaaggaacagatgcgccatgcaagatccccttttcgacccaagatgagaaaggggtgacccagaatgggagattgataacagccaatcccatagttactgacaaagaaaaaccagtcaacattgagacagaaccaccttttggtgagagctacatcgtggtaggggcaggtgaaaaagctttgaaactaagctggttcaagaaaggaagcagcatagggaaaatgttcgaagcaaccgcccgaggagcacgaaggatggctatcctgggagacaccgcatgggacttcggctctataggaggagtgttcacatctgtgggaaaattggtacaccaggtttttggaaccgcatatggtgttctgttcagcggtgtttcttggaccatgaaaataggaatagggattctgctgacatggttgggattaaattcaaggagcacgtcactttcgatgacgtgcattgcagttggcatggttacactgtacctaggagtcatggttcaagcggactcgggatgtgtaatcaactggaagggcagagaactcaaatgtggaagtggcatttttgtcactaatgaagtccacacttggacagagcaatacaaattccaggctgactccccaaaaagactgtcagcagccattggaagggcatgggaggagggcgtgtgtggaattcgatcagccacgcgtcttgagaacatcatgtggaagcaaatatcaaatgaattgaaccacattctactagaaaatgacataaaattcacagtggttgtaggaaatgctaatggaattttggcccaaggaaaaaaaatgattaggccacaacccatggaacacaaatactcatggaaaagctggggaaaagctaaaatcataggagcagacatacaaaataccaccttcatcatcgacggcccagatactccagaatgccccgatgaacaaagagcgtggaacatttgggaagttgaggactatgggtttggaattttcacgacaaacatatggctgaaattgcgtgactcctacacccaaatgtgtgaccaccggctaatgtcagctgccatcaaggacagcaaggcagtccatgctgacatggggtactggatagaaagtgaaaagaacgaaacctggaagctggcgagagcctcgttcatagaagtcaagacatgcatctggccgaaatcccacactctatggagtaatggagttttggaaagtgaaatgataatcccaaagatgtatggaggaccaatatctcagcacaactacagaccagggtatttcacacaaacagcagggccatggcatctaggcaagttggaattggattttgacttgtgtgaaggaaccacagttgttgtggatgaacattgtggaagtcgaggtccatctctcagaactacaacagtcacaggaaagataatccatgaatggtgttgcagatcctgcacgttaccccccttacgtttcagaggagaagacggatgttggtatggtatggaaatcagaccagttaaggagaaggaggagaacctagttaggtcaatggtctctgcagggtcaggagaagtagacagtttttcattaggaatactatgcgtatcaataatgattgaagaagtgatgagatccagatggagtagaaagatgctgatgactggaacactggctgttttcctccttcttataatgggacaactgacatggaatgatctgattaggttatgcatcatggttggagctaatgcttcagacaagatggggatgggaacaacgtacctagccttgatggctactttcaaaatgagaccaatgttcgctgttgggctattatttcgcagactaacatccagagaagttcttcttctcacgattggattaagcctggtggcatccgtggagctaccaaattctttggaggagctaggggatggacttgcaatgggtatcatgatgttaaaattattgactgaatttcagccacaccagttatggaccaccttactttctctgacatttatcaaaacaactctttcattggattacgcatggaagacaacggctacggtactgtcaatcgtatctctctttcctttatgcctgtctacgacctctcaaaaaacaacatggcttccggtgctgttaggatcttttggatgcaaaccattaaccatgtttctcataacagaaaacgaaatctggggaagaaaaagttggcccctcaatgaaggaattatggctattggaatagtcagcattctactaagttcactcctcaaaaatgatgtgccgttggccggcccactaatagctggaggcatgctaatagcgtgttatgtcatatccggaagctcagccgatctatcattggagaaagcggctgaggtatcctgggaagaagaagcagaacactccggtacctcacacaacatattagtagaggttcaagatgatggaactatgaaaataaaagatgaagagagggatgacacactcactatactccttaaagcaactttgctggcagtctcaggagtgtacccaatgtcaataccagcaactctttttgtgtggtatttttggcagaaaaagaaacagagatcaggagtgttatgggacacacccagccctccggaagtggaaagagcggttcttgatgatggcatctatagaatcttgcaaagaggactgttgggcaggtcccaagtaggagtgggagttttccaagacggcgtgttccacacaatgtggcacgtcaccaggggagctgtccttatgtaccaagggaagaggctggaaccaagctgggccagtgtcaaaaaggacttgatctcatatggaggaggttggaggtttcaaggatcatggaacacgggagaagaagtgcaggtgatagctgttgaaccaggaaaaaaccccaaaaatgtacagacaacgccgggtaccttcaagactcctgaaggcgaagttggagccatagctctagattttaaacccggcacatctggatctcccatcgtgaacagagagggaaaaatagtaggtctttatggaaatggagtggtgacaacaagtggaacctacgtcagtgccatagcccaagctaaagcatcacaggaagggcctctaccagagattgaggacgaggtgtttaagaaaagaaacttaacaataatggacctccatccaggatcaggaaaaacaagaagatatcttccagccatagtccgtgaggccataaaaaggaaactgcgtacgttaatcttggctcccacaagagttgtcgcctctgaaatggcagaggcgctcaagggaatgccaataagatatcagacaacagcagtgaagagtgagcacacaggaagggagatagttgacctcatgtgccacgccacttttaccatgcgtctcttatccccagtgagagttcccaattacaacatgattattatggatgaagcacattttaccgatccagccagcatagcggccagagggtacatctcaacccgagtgggtatgggtgaagcagctgcgatctttatgacagccactcccccaggatcggtggaggcctttccacagagcaatgcagttatccaagatgaggaaagagacattcctgagagatcatggaattcaggctacgactggatcactgattttccaggtaaaacagtctggtttgttccaagcattaaatcaggaaatgacattgccaactgcttaagaaagaacggaaaacgggtaatccaattgagcaggaaaacctttgacactgagtaccagaaaacaaaaaacaatgactgggactatgttgtcacaacagacatttctgaaatgggggcaaatttccgggctgacagggtaatagacccaaggcggtgtttgaaaccggtaatactaaaagatggtccagagcgtgttattctagccggaccgatgccagtgactgtggccagtgctgcccaaaggagaggaagaattggaaggaaccagaacaaggaaggtgatcagtatgtttacatgggacagcctttaaataatgatgaggatcacgctcattggacagaagcaaaaatgctccttgacaatataaacacaccagaagggatcatcccagccctctttgagccagagagagaaaagagtgcagcaatagacggggagtacagactgcggggagaagcaaggaaaacgttcgtggagctcatgagaagaggagatctaccagtttggctatcctacaaagttgcctcagaaggtttccagtactccgacagaaggtggtgctttgatggagaaaggaacaaccaggtgttggaggagaacatggacgtggagatctggacaaaggaaggagaaagaaagaaattgcgaccccgctggttggatgccagaacatactctgatccactggccctgcgcgagtttaaagagtttgcagcaggaagaagaagtgtctcaagtgacctaatattggaaatagggaaacttccacaacatttgacgctaagagcccagaatgctctggataacttggtcatgttgcataattccgaacaaggaggaaaagcctatagacatgctatggaggaactaccagacaccatagaaacattgatgctcctagctttgatagctgtgttgactggtggagtgacgctgttcttcctatcaggaaaaggtctagggaaaacatccattggcttgctctgtgtgacggcctcaagcgcactgttatggatggccagtgtggagccccattggatagcggcctccatcatactagagttctttttgatggtgctgctcattccagagccagacagacagcgcactccacaggacaaccagctagcatatgtggtgataggtttgttattcatgatactgacagtggcagccaatgagatgggattattggaaaccacaaagaaagacctggggattggccatgtagccgccgaaaaccaccaacatgctacaatgctggacgtagacttacatccagcttcagcctggactctctatgcagtagccacaacagtcatcactcccatgatgagacacacaattgaaaatacaacggcaaacatttccctgacagccattgcaaatcaggcagctatattgatgggacttgacaagggatggccaatatcgaagatggacctaggagttccacttctcgccttagggtgctattcccaggtgaacccattgacactgacagcggcggtgttgatgttagtggctcattatgccataattggaccaggactgcaagcaaaggccactagagaagctcaaaaaaggacagcggccggaataatgaaaaatccaaccgtagacgggattgttgcaatagacttggatcctgtggtttatgatgcaaaatttgaaaaacagctaggccaaataatgttactgatactttgtacatcacagatcctcttgatgcggaccacatgggccttgtgtgaatctatcacactggctactggacccctgaccactctttgggagggatctccaggaaaattctggaataccacgatagcagtgtccatggcaaacatcttcaggggaagttatctagcaggagcaggtctggccttctcattaatgaaatctttaggaggaggtaggagaggtacgggagctcaaggggaaacattgggagagaaatggaaaagacagttaaaccaactgagcaagtcagaattcaacacctacaaaaggagtgggattatggaggtggacagatctgaagccaaagagggactgaaaagaggagaaacaaccaaacatgcagtgtcgagaggaacagccaaactgaggtggtttgtggagaggaacctcgtgaaaccagaagggaaagtcatagacctcggttgtggaagaggtggctggtcatattattgtgctgggctgaagaaagtcactgaagtgaagggatacacaaaaggaggacctggacatgaggaacccatcccaatggcgacctatggatggaacctagtgaagctgcactctggaaaagatgtattttttataccacctgagaaatgtgacacccttctgtgtgatattggtgagtcctctccaaatccaactatagaagaaggtagaacgctacgtgttctaaagatggtggaaccatggctcagaggcaaccaattctgcataaaaatcctaaatccttacatgccaagtgtggtagaaactctggagcaaatgcaaagaaaacatggagggatgctagtgcgaaacccactctcaagaaattccacccatgaaatgtactgggtttcatgtgggacaggaaacattgtgtcggcagtgaacatgacatccagaatgttgctgaatcgattcacaatggctcataggaagccaacatatgaaagagacgtggacttaggcgctggaacaagacatgtggcagtggaaccagaggtagccaacctagatatcattggccagaggatagagaatataaaaaatgaacacaagtcaacatggcattatgatgaagacaatccatacaaaacatgggcctatcatggatcatatgaggttaagccatcaggatcagcctcatctatggtgaatggagtggtgagattgctcacaaaaccatgggatgttatccccatggtcacacaaatagctatgactgataccacaccctttggacaacagagagtgtttaaagagaaggttgacacgcgcacaccaagagcaaaacgaggcacagcacaaattatggaagtgacagccaagtggttatggggtttcctttccagaaacaaaaaacccagaatctgcacaagagaggagttcacaagaaaggttaggtcaaacgcagcaataggagcagtgttcgttgatgaaaaccaatggaactcagcaaaagaagcagtggaagacgaaaggttttgggatctcgtgcacagagagagggagcttcataaacagggaaaatgtgccacgtgtgtctacaacatgatggggaagagagagaaaaaattaggagagtttggaaaggcaaaaggaagtcgtgcaatatggtacatgtggctgggagcacgctttctggagttcgaggcccttggtttcatgaatgaagatcactggtttagtagagagaattcactcagtggagtggaaggagaaggactgcacaaacttggatacatactcagagacatatcaaagattccggggggaaatatgtatgcagatgatacagccggatgggacacaagaataacagaggatgatcttcagaatgaggctaaaatcactgacatcatggagcctgaacatgctctattggctacgtcaatttttaagctgacctaccaaaacaaggtggtgagggtgcaaagaccagcaaaaaatggaaccgtgatggatgttatatccagacgtgaccagagaggaagtggacaggtcggaacttatggcttaaatactttcactaatatggaggtccaactaataagacaaatggagtctgaaggaatcttttttcccagcgaattggaaagccccaatctagctgaaagagttcttgactggttggaaaaacatggcgccgaaaggctgaaaagaatggcaatcagcggagatgattgtgtagtgaaaccaattgatgacagattcgcaacagccttaatagctctgaatgacatgggaaaagtaagaaaagacataccgcagtgggaaccttcaaaaggatggaatgattggcagcaagtgcctttctgttcacaccatttccaccagctgatcatgaaggatgggagggaaatagtggtgccatgtcgcaaccaagatgaacttgtgggcagggctagagtatcacaaggcgccggatggagcctgagagaaactgcttgcctaggcaagtcatatgcacaaatgtggcagctgatgtacttccacaggagagacctgagactagcggctaatgctatctgttcagccgtcccagttgattgggtcccaaccagccgcacaacctggtcaatccatgcccaccaccaatggatgacaacagaagacatgttatcagtgtggaatagggtttggatagaggaaaacccatggatggaggacaaaactcatgtatccagttgggaagaagttccatacctagggaaaagggaagatcaatggtgtggatccctgataggcttgacagcgagggccacctgggccaccaacatacaagtagccataaaccaagtgagaaggctcatcgggaatgagaattatctagattacatgacatcaatgaagagattcaagaatgagagtgatcccgaaggggcactctggtga

SEQ ID NO: 6358 - RNA, 9879 nt, synthetic construct
  misc_feature 1..9879: note = derived and/or modified CDS sequence (wt) from DENV-1__EU280167__SS-prME
  source 1..9879: mol_type = other RNA
tctgtgaccatgctccttacgctgatgcctacagccttggcgttccatttgactacacgagggggagagccgcacatgatagtcagcaagcaggaaagaggaaagtcacttttgttcaagacctcagcaggtgtcaacatgtgcacccttatagcgatggatttgggagagttatgtgaggacacagtgacttacaaatgccctcgaatcactgaggcggaaccagatgacgttgattgttggtgcaatgccacagacacatgggtgacctatggaacatgttcccaaactggcgagcaccgacgagacatacgttccgtcgcactggccccacacgtgggacttggtttggaaacaagaactgaaacgtggatgtcctctgaaggcgcttggaaacagatacaaagagtggatacttgtgtcctgagacacccaggattcacggtgatagccctttttctagcacatgccataggaacatccatcagccagaaagggattattttcattttgttaatgctggtaacaccatccatgaccatgcgatgcgtgggaataggcagcagggacttcgtggaaggactgtcaggagcaacttgggtagatgtggtactggaacatggaagttgtgtcaccagcatggcaaaagacaaaccaacactggacattgaactgttgaagacggaagtcccaaaccctgccgtcctgcgcaaactgtgcattgaagctaaaatatcaaacaccaccactgactcaagatgtccaacacaaggagaagccacactggtggaagaacaagacgcgaactttgtgtgtcgacgaacgtttgtggacagaggctggggcaatggctgtgggctcttcggaaaaggaagcctactaacgtgtgataagttcaagtgtgtgacaaaactggaaggaaagataattcaatatgaaaactttaaatattcagtaatagtcaccgtccacactggagaccagcatcaggtgggaaatgaaagcacagaacatgggacaactgcaactataacacctcaagctcctacgacggaaatacagctgaccgactacggagctcttacattggattgttcacctagaacaggattagactttaatgaaatggtgttgttgacaatgaaagaaaaatcatggctagtccacaaacaatggtttctagacttaccactgccttggacctcgggagcttcaacatcacgagagacctggaacagacaagatttgctggtgacatttaagacagctcatgcaaagaagcaggaagtagtcgtactaggatcacaagaaggagcaatgcacactgcgttgaccggagcgacagaaatccaaacgtctggaacgacaacaatttttgcaggacacttgaaatgtagactaaagatggacaaactgactctaaaagggatgtcatatgtgatgtgcacaggctcattcaagctagagaaagaagtggctgagacccagcatggaaccgttctagtgcagattaaatacgaaggaacagatgcaccatgcaagatccctttttcgacccaagatgaaaaaggagtaacccagaatggaagattgataacagccaaccccatagtcactgacaaagaaaaaccagtcaacattgaggcagaaccgccttttggtgagagttacatcgtgataggagtaggtgaaaaagctttgaaactaagctggttcaagaaaggaagcagcatagggaaaatgtttgaggcaactgccagaggagcacgaaggatggccatactgggagacaccgcatgggactttggttctataggaggagtgttcacgtctgttggaaaattagtacaccagatttttggaactgcatatggagttttgttcagcggtgtttcctggaccatgaaaataggaataggggttctgctgacatggttaggattaaactcaaggagcacgtccctctcgatgacgtgcattgcagttggcctagtaacactatacctaggagtcatggttcaggcggattcaggatgcgtaattaattggaagggtagaggactcaaatgtggaagtggcatttttgtcaccaatgaagttcacacttggacagggcaatacaaatttcaagctgactccccaaaaggactatcagcagccatcgggaaggcatgggaggagggtgtgtgtggaattcgatcagcaactcgtctcgagaacatcatgtggaagcaaatatcaaatgaactgaaccacatcttacttgaaaatgacatgaaattcacagtggttgtaggagatgttgctgggatcttggctcaaggaaaaaaaatgattaggccacaacccatggaacacaaatactcgtggaaaaattggggaaaggctaaaatcataggggcagatgtacagaactccaccttcatcattgacggcccaaacaccccagaatgctctgatgaccaaagagcatggaacatttgggaagttgaggactatggatttggaattttcacgacaaacatatggctgaaattgcgtgactcctacacccaagtgtgtgaccaccggctaatgtcagcagccatcaaggacagcaaggcagttcacgctgacatggggtactggatagaaagtgaaaagaacgagacctggaagctggcaagagcctctttcatagaagttaaaacatgtatttggccaaaatcccacactctatggagcaatggagttctggaaagtgaaatgataattccaaagatctatggaggaccaatatctcagcataactacagaccaggatatttcacacaaacggcagggccgtggcacctaggcaagttggaattggattttgatttgtgtgagggtaccacagtcgttgtggatgaacattgtggaaatcgaggaccatctcttgggaccacaacagtcacaggaaagataattcatgaatggtgttgcagatcttgtacgctaccacccttacgtttcagaggagaagatgggtgctggtacggtatggaaatcagacccgtcaaggaaaaggaagagaatctagtcaaatcaatggtctctgcagggtcaggggaagtggacagcttttcactgggactgctatgcatatcaataatgatcgaagaggtgatgagatccagatggagtagaaaaatgctgatgactggaacactggctgtgttcttccttctcataatgggacaattgacatggaatgatctgatcagattatgcatcatggttggagccaacgcttccgacagaatggggatgggaacgacgtacctagctctgatggccacttttaaaatgagaccaatgtttgctgtagggctattattccgcagactaacatccagagaagttcttcttctaaccattggattgagtctagtggcatctgtggagttaccaaattccttggaggagctgggggatggacttgcaatgggcattatgattttaaaattattgactgactttcgatcacatcagttgtgggctaccttgctgtccatgacatttatcaaaacagcgttttccttgcactatgcatggaagacaatggctatggtactgtcaattgtatctctcttccccttatgcctgtacacgacctcccagaaaacaacatggcttccggtgctattgggatctcttggatgcaaaccactaaccatgttccttatagcagaaaacaaaatctggggaaggaaaagctggcccctcaatgaagggatcatggctgttggaatagtcagcatcctactaagttcactcctcaaaaatgatgtgccgctagctgggccactaatagctggaggtatgctaatagcatgttatgttatatctggaagctcagccgacctatcactagagaaagcagctgaggtctcctgggaagaagaagcagaacactctggtgcctcacacaacatattagtggaggttcaagacgatggaaccatgaagataaaggatgaagagagagatgacacgctaaccattctccttaaagcaactctgctagcagtttcaggggtgtacccattatcaataccagcgaccctttttgtgtggtgcttttggcagaaaaagaaacagagatctggagtgttatgggacacacctagccctccaaaagtggaaagagcagttcttgatgatggtatctatagaattatgcagagaggactgttgggcaggtcccaagtaggggtaggagtttttcaagaaaacgtgttccatacaatgtggcatgtcaccaggggagctgtactcatgtatcaagggaagagactggaaccgagctgggccagtgtcaaaaaagacctgatctcatatggaggaggttggaggcttcaaggatcctggaacacgggagaagaagtgcaggtgattgctgttgaaccagggaaaaaccccaaaaatgtacaaacggcgccgggcacctttaagacccctgaaggtgaagttggagccattgccctagattttaaacccggtacatctggatcccccatcgtgaacagagaagggaaaatagtaggtctttatggaaatggagtagtgacaacaagtggaacctacgtcagtgccatagctcaagccaaagcatcacaagaagggcccctaccagagattgaagacgaagtgttcaggaaaagaaacttaacaataatggacctacatccaggatcggggaaaacaagaagatatcttccagccatagtccgtgaggccataaaaaggaagatgcgcacactaattctggctcccacaagggttgtcgcttccgaaatggcagaagcactcaagggaatgccaataaggtaccaaacaacagcagtgaagagtgaacacacaggaaaagagatagttgacctcatgtgtcacgccactttcaccatgcgcctcctgtctcccgtgagagttcccaattacaacatgattatcatggatgaagcacatttcaccgatccatccagcatagcggccagagggtacatctcaacccgagtgggcatgggtgaagcagctgcgatcttcatgacagccactcccccaggatcagtggaggcctttccacagagtaacgcagtcatccaagatgaggaaagagacattcctgagagatcatggaactcaggctatgagtggatcactgacttcccaggtaaaacagtctggtttgttccaagcattaaagcaggaaatgacattaccaactgcttaagaaagaatggaaaacgagtgattcaattgagcaggaagacctttgatacagagtaccaaaaaacaaaaaataacgactgggactacgtcgtcacaacagacatctccgaaatgggagcaaacttccgggccgacagggtgatggacccaagacggtgtctgaaaccggtaatactaaaagatggtccagagcgcgtcattttagcaggaccgatgccagtgactgtggccagtgccgcccagaggagaggaagaattggaaggaaccacaataaggaaggtgatcagtacatctacatgggacagcctttaaccaacgatgaagatcacgctcactggactgaagcaaaaatgctccttgataatataaacacaccagaagggattatcccagccctcttcgagccggagagagaaaagagtgcagcaatagacggggaatacagactgcggggtgaagcaaggaaaacgtttgtggagctcatgagaagaggagatctacctgtctggctatcccacaaagttgcctcagaaggcttccagtactctgacagaagatggtgctttgacggggaaaggaacaaccaggtgttggaggagaacatggacgtggagatttggacaaaagaaggagaaagaaagaagctacgcccccgctggctggatgccagaacatactcagacccactggccctgcgcgagtttaaagagtttgcagcaggaagaagaagcgtctcaggtgatctaatactagaaatagggaaacttccacaacacttgacgcaaagggcccagaatgccttggacaacctggtcatgttgcacaactccgaacaaggaggaagagcctatagacatgcaatggaagaactgccagataccatagaaacgttgatgctcctagctttgatagccgtgttaactggtggagtgacgctgttcttcctatcaggaaagggcctagggaaaacatctatcgggctactctgcgtgatggcttcaagcgtactgctatggatggccagtgtggagccccattggatagcggcctccatcatattggagttcttcctgatggtgttgcttattccagagccagacagacaacgcactccgcaggacaaccagctggcatatgtggtgataggtttgttattcatgatactgacagtagcagccaatgagatgggactgctggaaaccacaaagaaagacttagggattggccatgtggctgttgaaaatcaccaccatgccgcaatgctggacgtagacttacatccagcttcagcctggaccctctatgcagtggccacaacaattatcacccccatgatgaggcacacaatcgaaaacacaacggcaaacatttccctgacagccattgcaaaccaggcagctatattgatgggacttgacaaaggatggccaatatcgaagatggacataggagttccacttctcgccttggggtgctattcccaggtgaacccactgacgctgacagcggcggtgttgatgctagtggctcattacgccataattggacctggactgcaagcaaaagctactagagaagctcaaaaaaggacagcggccggaataatgaaaaatccaaccattgatggaattgttgcaatagatttggaccctgtggtttatgatgcaaaatttgagaaacaactaggccaaataatgctgttgatactatgcacatcacagatcctcttgatgcggactacatgggccttgtgcgaatccatcacactggccactggacctctgaccacactttgggaaggatctccaggaaaattttggaacaccacgatagcggtttccatggcaaacattttcagaggaagttatctagcaggagcaggtctggctttctcattaatgaaatctctaggaggaggtaggagaggcacgggagcccaaggggaaacactgggagagaaatggaaaagacagctgaaccaactgagcaagtcagaattcaacacctataaaaggagtgggattatggaagtggacagatccgaagccaaagagggactgaaaagaggagaaacaaccaaacatgcagtgtcgagaggaaccgctaaactgaggtggtttgtggagaggaaccttgtgaaaccagaagggaaagtcatagacctcggttgtggaagaggtggctggtcatactattgcgctgggctgaagaaagtcacagaagtgaagggatatacaaaaggaggacctggacatgaggaaccaatcccaatggcgacctatggatggaacctagtaaaactgcactccgggaaagacgtattttttataccacctgagaaatgtgatacccttttgtgtgatattggtgagtcctctccaaacccaactatagaggaaggaagaacgctacgcgttctaaagatggtggaaccatggctcagaggaaaccaattttgcataaaaattctgaatccctacatgccaagtgtggtggaaactctggagcaaatgcaaagaaaacatggaggaatgctagtgcgaaatccactttcaagaaattctactcatgaaatgtattgggtttcatgtggaacgggaaacattgtgtcagcagtaaacatgacatccagaatgttgctaaatcgattcacaatggctcacaggaaaccaacatatgaaagagacgtggacctaggcgccggaacaagacatgtggcagtggaaccagaggtagccaacctagatatcattggccagaggatagagaacataaaacatgaacataagtcaacatggcattatgatgaggacaatccatataaaacatgggcctatcatggatcatatgaggtcaagccatcaggatcagcctcatccatggtcaatggcgtggtgaaactgctcaccaaaccatgggatgttatccccatggtcacacaaatagccatgactgacactacaccctttggacaacagagggtgtttaaagagaaagttgacacacgcacaccaaaagcaaaacgaggcacagcacaaatcatggtagtgacggccaggtggttatggagttttctttctagaaacaagaaaccaagaatttgtacaagagaggagttcacaagaaaagttaggtcaaacgcagccattggagcagtgttcgttgatgaaaatcaatggaactcagcaaaagaagcagtggaagatgaccggttctgggaccttgtgcacagagagagggagcttcacaaacagggaaaatgtgccacgtgtgtttacaacacgatggggaagagagagaaaaagctaggagagttcggaaaggcaaaaggaagtcgtgcaatatggtacatgtggttgggagcacgctttctagagttcgaagctcttggtttcatgaacgaagatcactggttcagcagagagaattcactcagcggagtggaaggagaaggacttcacaaacttggatatatactcagagacatatcaaagattccagggggaaacatgtatgcagatgacacagccggatgggatacaaggataacagagggtgacctccagaatgaggccaaaattactgacatcatggaacccgaacatgccctactggctaagtcaatcttcaagctaacctaccaaaataaggtggtaagggtacagagaccagcaaaaaatggaaccgtgatggatgtcatatccagacgtgaccagagaggaagtggccaggttggaacttatggcttaaacactttcaccaacatggaagcccagctgataagacaaatggagtctgagggaatcttttcacccaacgaattagagaccccaaatttagccgagagagttctcgactggctggaaaaatatggcgtcgaaaggctgaaaagaatggcaatcagcggagatgactgcgtagtgaaaccaattgatgataggtttgcgacagccttaacagctctgaatgatatgggaaaagtaagaaaagatataccacaatgggaaccttcaaaaggatggaatgattggcaacaagtgcctttttgttcacaccacttccaccagctgattatgaaggatgggagggaaatagtggtgccatgccgcaaccaagatgaacttgtgggtagggctagagtatcacaaggtgctgggtggagcctgagagaaactgcatgcctaggcaagtcatatgcacaaatgtggcagctgatgtacttccacaggagagacctgagactagccgctaatgctatctgttcagccgttccagttgattgggttccaactagccgcaccacttggtcgatccatgcccatcaccaatggatgacaacagaagacatgctgtcagtatggaatagggtttggatagaggaaaacccatggatggaggacaaaacccgtatatccagttgggaagatgttccatacctaggggaaagggaagatcaatggtgtggatctctgataggcttaacagcaagggccacctgggccaccaacgtacaagtggccataaaccaagtgagaagactaattgggaatgagaattattcggattacatgacatcaatgaagagattcaagaacaagagtgaacccgaaggggcactctggtga

SEQ ID NO: 6359 - RNA, 9876 nt, synthetic construct
  misc_feature 1..9876: note = derived and/or modified CDS sequence (wt) from DENV-2__AJ968413__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtctcctgtttaaaacagaggatggtgtgaacatgtgtaccctcatggccatggaccttggtgaattgtgtgaagatacaatcacgtataagtgtcctcttctcaggcagaatgaaccagaagacatagattgttggtgtaactctacgtccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgcgacatccaggctttaccttaatggcagcaatcctggcatacaccataggaacgacacatttccaaagagctctgatcttcatcttactgacagccgtcgctccttcaatgacaatgcgttgcataggaatatcaaacagagattttgtagaaggggtttcaggaggaagctgggttgacatagtcttagaacatggaagctgtgtgacgacaatggccaaaaacaaaccaacattggattttgaactgataaaaacagaagccaaacaacttgccactctaaggaagtactgtatagaggcaaagttaaccaacacaacaacagaatctcgctgtccaacacaaggggaacccagcctaaatgaagagcaggacaaaaggttcgtctgcaaacactccatggtagacagaggatggggaaatggatgtggactatttggaaaaggaggcattgtgacctgtgctatgttcacatgcaaaaagaacatggaaggaaaaattgtgcaaccagaaaacttggaatataccatcgtgataacaccccactcaggggaagagcacgcagttggaaatgacacaggaaaacatggcaaggaaatcaaaataacaccacagagttccatcacagaagcagagttgacaggctatggcactgtcacgatggagtgctctccgagaacgggcctcgacttcaacgagatggtgttgttgcaaatggaaaataaagcttggctggtgcaccggcaatggttcctagacctgccgttgccatggttgcccggagcggacacacaaggatcaaattggatacagaaggagacattggtcactttcaaaaatccccatgcgaagaaacaagatgttgttgttttaggatcccaagaaggggctatgcacacagcactcacaggggccacagaaatccagatgtcatcagggaacttactgttcacaggacatctcaagtgcaggctgaggatggacaaactacagctcaaaggaatgtcatactccatgtgcacaggaaagtttaaagttgtgaaggaaatagcagaaacacaacatggaacaatagttgtcagagtacaatatgaaggggacggttctccatgtaagattccctttgagataatggatttggaaaaaagacatgtcttgggtcgcctgattacagtcaacccaattgtgacagaaaaggatagcccagtcaacatagaagcagaacctccattcggagacagctacgtcatcataggagtagagccggggcaattgaagcttaattggtttaagaaaggaagttctatcggccaaatgtttgagacaacaatgaggggagcgaagagaatggctattctaggtgacacagcttgggattttggatccctgggaggagtgttcacatctataggaaaggctctccaccaggtttttggagcaatctacggggctgccttcagtggggtctcgtggactatgaaaatcctcataggagtcattattacatggataggaatgaattcacgtagcacctcactgtctgtatcactagtattggtgggagtcgtgacactgtacttgggagtcgtggtgcaggccgatagtggttgcgttgtgagctggaaaaacaaagaactgaaatgtggcagtgggattttcatcacagacaatgtgcacacatggacagaacaatacaagttccaaccagaatccccttcaaaactagcttcagctatccagaaagctcatcaagagggcatttgtggaatccgctcagtaacaagactggaaaatttgatgtggaaacaaataacaccggaattgaatcacattctatcagaaaatgaggtgaagctgactattatgacaggagacatcaaaggaatcatgcatgcaggaaaacgatctctgcggcctcagcccactgagctgaggtattcatggaagacatggggcaaagcgaaaatcctctctacagagtcccataaccagacctttctcattgatggccccgaaacagcagaatgccccaacacaaacagagcttggaattcgctggaagttgaagactatggttttggagtattcaccaccaatatatggctaaagctgagagaaaagcaagatgtattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaattttgctggaccagtgtcacaacacaattacagaccaggctaccatacacaaacagcaggaccatggcatttaggtaagcttgagatggactttgatttctgcgaaggaactacagtggtggtgactgaggactgtggaaatagaggaccctccttaagaacaaccactgcctctggaaaactcataacagaatggtgctgcagatcttgcacattaccaccactaagatacagaggtgaggatggatgctggtacgggatggaaatcagaccattgaaagagaaagaagagaatttggtcaactccttggtcacagccggacatgggcagattgacaacttctcactaggagtcttgggaatggcattgttcctggaagaaatgctcaggacccgagtaggaacgaaacatgcaacactactagttgcagtttcttttgtgacattaatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggagtcgtactcctctcccagagcaccataccagagaccattcttgaactgactgatgcgttagccttgggcatgatggtcctcaaaatagtgagaaaaatggaaaggtatcaattggcagtgactatcacggctatcttgtgcgtcccaaatgcagtgatattacaaaacgcatggaaagtgagctgcacaatattggcagtggtgtccgtttccccactgctcttaacatcctcacagcaaaaagcggattggataccattagcattgacgattaaaggtctcaatccaacagctatatttctaacaaccctttcacgaactagcaagaaaaggagctggccactaaatgaggctatcatggcagtcgggatggtgagcattttagccagttcacttctaaagaatgacattcccatgacaggaccactagtggctggagggctcctcactgtatgctacgtgctcactggacgatcggccgatttggaattggagaaagctgccgacgtcagatgggaagatcaggcagagatatcaggaagcagtccaattctgtcaataacaatatcagaagatggtagcatgtcaataaaaaacgaagaggaagaacaaacactgaccatacttattagaacaggattgctggtgatctcaggactttttcctgtatcaataccaatcacggcagcagcatggtacctgtgggaagtgaagaaacaacgggctggagtattgtgggatgtcccttcacccccacctgtgggaaaggctgaactggaagatggagcctatagaatcaagcaaaaagggattcttggatattcccagatcggagccggagtttacaaagaaggaacattccatacaatgtggcatgtcacacgtggcgccgttctaatgcataaaggaaagaggattgagccatcatgggcggacgttaaaaaagacctaatatcatatggaggaggctggaaactagaaggagaatggaaggaaggagaagaagtccaggtcttggcattggagcctggaaaaaatccaagagccgtccaaacaaaacctggtcttttcaaaaccaataccggaactataggtgccgtatctctggacttttctcctggaacgtcaggatcaccaatcattgacaaaaaaggaaaggtggtgggtctttatggtaacggcgttgttacaaggaatggagcatatgtgagtgctatagcccagacggaaaaaagcattgaagacaatccagagattgaagatgacatttttcgaaagaaaagattgaccattatggacctccacccaggagcaggaaagacgaaaagataccttccggccatagtcagagaggctataaaacggggcctgaggacattaattctggcccccactagagtcgtggcagctgaaatggaggaagctcttaggggacttccaataagataccaaaccccagccatcagagccgagcacaccgggcgagagattgtggacctaatgtgtcatgccacattcactatgaggctgctatcgccagttagagtaccaaattacaacctgattatcatggacgaagcccatttcacagacccagcaagtatagcggccagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtctggttcgttccaagtataaaagcaggaaatgacatagcagcttgcctgagaaaaaatggaaagaaagtgatacaactcagcaggaaaacctttgattctgagtatgtcaagactagaaccaatgattgggactttgtggttacaactgacatttcagaaatgggtgccaacttcaaggctgagagggttatagatcccagacgctgcatgaaaccagtcatactaacagatggtgaagagcgggtgatcctagcaggacccatgccagtgacccactctagtgcagcacaaagaagagggagaataggaagaaatccaaaaaatgaaaacgaccagtacatatacatgggggaacctctggaaaatgacgaagactgtgcacattggaaagaagctaaaatgctcctagataacatcaatacacctgaaggaatcattcctagcatgttcgaaccagagcgcgaaaaggtggatgccattgatggtgaataccgcttgagaggagaagcacggaaaacctttgtagacctaatgagaagaggagacctaccagtctggttagcctacaaggtggcagctgaaggcatcaactacgcagacagaaggtggtgttttgatggaatcaggaacaaccaaatcttggaagaaaatgtggaagtggaaatctggacaaaagaaggggaaaggaagaaattaaaacccagatggttggacgccaggatctattctgacccactagcgctaaaagaattcaaggaatttgcagctggaagaaagtccttgaccctgaacctaatcacagaaatgggaaggcttccaactttcatgactcagaaggcaagagacgcattggacaacctggcagtgctgcacacggctgaagcaggtggaagggcgtacaatcatgctctcagtgaactgccggagaccctggagacattacttttactgacactcctggctacagtcacgggaggaatctttttgttcttgatgagcggaagaggtatagggaagatgaccttaggaatgtgctgcataatcacggccagtattcttctatggtacgcacaaatacagccacactggatagcagcttcaataatattggaattttttctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattaggaagcattacaacccagcaacccgagagcaacatcctggacatagatctacgtcctgcatcagcatggacgctgtatgccgtggccacaacattcgtcacaccaatgttgagacatagcattgaaaattcctcagtgaacgtgtccctaacagctattgccaaccaagccacagtgttaatgggccttgggaaaggatggccactgtcaaagatggacatcggagttccccttctcgccattggatgctactcacaagttaaccccataacactcacagcagctcttctcttattggtagcacattatgctatcatagggccaggactccaagcaaaagcaactagagaagctcagaaaagagcagcagcgggcatcatgaaaaacccaactgtcgatggaataacagtaattgacctagatccaataccctatgatccaaagtttgaaaagcagttgggacaagtaatgctcctagtcctctgtgtgactcaagtattgatgatgaggactacatgggctctgtgtgaggctttaaccttagcgaccgggcccatttccacattgtgggaaggaaatccagggaggttttggaacactaccattgcagtgtcaatggctaacatttttagaggaagttacttggctggagctggacttctcttttctatcatgaagaacacaaccaatacaagaaggggaactggcaacataggagagacgcttggagagaaatggaaaaaccggttgaacgcattggggaaaagtgaattccagatctacaagaaaagtggaatccaggaagtagatagaaccttagcaaaagaaggcattaaaagaggagaaacggaccatcacgctgtgtcgcgaggctcagcaaaactgagatggttcgtcgagagaaatatggtcacaccagaagggaaagtagtggaccttggttgcggcagaggaggctggtcatactattgtgggggactaaagaatgtaagagaagtcaaaggcctgacaaaaggaggaccagggcacgaagaacccatccctatgtcaacatatggatggaatctagtgcgtcttcaaagtggagttgatgttttctttactccgccagaaaagtgcgacacattgctgtgtgacataggggagtcgtcaccaaatcccacggtagaagcaggacgaacactcagagtcctcaacttagtggaaaattggttgaacaacaacatccaattttgcataaaggttctcaacccatacatgccctcagtcatagaaaaaatggaagcactacaaaggaaatatggaggagccttagtgagaaatccactctcacgaaactctacacatgagatgtactgggtatccaatgcctctgggaacatagtgtcatcagtgaacatgatttcaaggatgttgatcaatagattcacaatgaaacacaagaaagccacttacgagccagatgttgacctaggaagcggaacccgcaacatcggaattgaaagtgaggtaccaaacctggacataattgggaaaagaatagaaaaaataaaacaagagcatgaaacatcatggcactatgaccaagaccacccatacaaaacatgggcttaccatggtagctatgaaacaaaacaaactggatcagcatcatccatggtgaacggagtggtcagactgctgacaaaaccttgggacgtcgtccccatggtgacacagatggcaatgacagatacgactccatttggacaacagcgcgtttttaaagagaaagtggacacgagaacccaagaaccgaaagaaggcacaaagaaattaatgaaaatcacggcagaatggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggggctggttgacaaggaaaggaatctccatcttgaaggaaagtgtgaaacatgtgtgtacaacatgatggggaaaagagagaagaagctaggggagttcggcaaggcaaaaggcagcagagccatatggtatatgtggcttggagcacgctttttagagtttgaagccctaggattcttgaatgaagatcactggttctccagagagaactccctgagtggagtggaaggagaagggctgcacaagctaggctacattttaagagacgtgagcaagaaagagggaggagcaatgtatgctgatgacaccgcaggatgggacacaagaatcacactggaagatttaaaaaatgaagaaatggtaacaaaccacatggaaggagaacacaagaaactagccgaggctattttcaaattaacataccaaaacaaggtggtgcgtgtgcaaagaccaacaccaaggggcacagtaatggatatcatatcgagaagagaccaaagaggtagcggacaagttggtacctatggactcaatactttcaccaatatggaagcccaactaatcagacagatggaaggagaaggagtcttcaaaagcattcagcacctgacggtcacagaagaaatcgccgtgcaaaactggctagcaagagtagggcgcgaaaggttatcaagaatggccatcagtggagatgattgtgttgtgaaacctttagatgacagattcgcaagcgctttaacagctctaaatgacatgggaaaggtcaggaaagacatacaacaatgggaaccttcaagagggtggaacgactggacacaagtgcccttctgttcacatcatttccatgagttaatcatgaaagacggtcgcgtacttgtagttccatgtagaaaccaggatgaattaattggtagagcccgaatttcccagggagctggatggtctttgagggagacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacacgccaaacatgaatggatgacaacggaagacatgctgacagtctggaacagggtgtggattcaagaaaatccatggatggaagacaaaactccagtggaatcatgggaggagatcccatatttggggaaaagagaagaccaatggtgcggctcactgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6360 - RNA, 9876 nt, synthetic construct
  misc_feature 1..9876: note = derived and/or modified CDS sequence (wt) from DENV-2__AB543624__SS-prME
  source 1..9876: mol_type = other RNA
tctgcaggcatgatcattatgctgattccaacagtgatggcgttccatctaaccacacgcaacggagaaccacacatgatcgtcggtatacaggagaaagggaaaagtcttctgttcaaaacagaggatggtgtgaacatgtgcaccctcatggctatggaccttggtgaattgtgtgaagacacaatcacgtacaagtgtcctcttctcaggcagaatgagccagaagatatagactgctggtgcaactccacgtccacgtgggtaacctatgggacctgtaccactacgggagaacataggagagaaaaaagatcagtggcactcgttccacatgtgggaatgggactggagacgcgaactgaaacatggatgtcatcagaaggggcttggaaacatgcccagagaattgaaacttggatcctgagacatccaggcttcaccataatggcagcaatcctggcatacaccatagggacgacacatttccagagagtcctgattttcatcctactgacagctgtcgctccttcaatgacaatgcgttgcataggaatatcaaatagagactttgtagaaggggtttcaggaggaagttgggttgacatagtcttagaacatggaagctgtgtgacgacgatggcaaaaaacaaaccaacattggatttcgaactgataaaaacggaagccaaacagcctgccaccctaaggaagtactgcatagaagcaaaactaaccaacacaacaacagaatcccgttgcccaacacaaggggaacccagcctgaaagaagagcaggataagaggttcgtctgcaaacactccatggtagacagaggatggggaaatggatgtggattatttggaaagggaggcattgtgacctgtgctatgttcacatgcaaaaagaacatggaagggaaaatcgtgcaaccagaaaacttggaatacaccattgtggtaacacctcactcaggggaagagcatgcggtcggaaatgacacaggaaaacacggcaaggaaatcaaagtaacaccacagagttccatcacagaagcagaattgataggttatggcaccgtcacgatggagtgctccccgagaacaggcctcgacttcaatgagatggtgttgctgcagatggaaaataaagcttggctggtgcataggcaatggtttctagacctgccattaccatggctgcccggagcggataaacaagagtcaaattggatacagaaagaaacattggtcactttcaaaaatccccatgcgaagaaacaggatgttgttgttttaggatccccagaaggggctatgcatacagcactcacaggagccacagaaatccaaatgtcgtcaggaaacttgctcttcactggacatctcaagtgcaggctgagaatggacaagctacagctcaaaggaatgtcatactctatgtgcacaggaaagtttaaagttgtgaaggaaatagcagaaacacaacatggaacgatagttatcagagtgcaatatgaaggggacggctctccatgcaaaatccctttcgagataatggatttggaaaaaagatatgtcttaggccgcctgatcacagtcaacccaattgtaacagaaaaagataacccagtcaacatagaagcagaacctccattcggagacagttacatcatcataggagtagagccgggacaactgaagctcaactggttcaagaaaggaagttctatcggccaaatgtttgagacaacgatgagaggggcgaagagaatggccattttgggtgacacagcctgggacttcggatccctgggaggagtgtttacatctataggaaaagctctccaccaagtctttggagcaatctatggagctgccttcagtggggtttcatggaccatgaaaatcctcataggagtcattatcacatggataggaatgaactcacgcagcacctcactgtctgtgtcactagtactggtgggaattgtgacactgtatttgggagtcatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcaggaagagggaatttgtgggatccgctcggtaacaagattggagaacctaatgtggaaacaaatagcaccagaattgaatcacattctagcagaaaatgaggtgaagttaactatcatgacaggagacatcaaaggaatcatgcaggcaggaaaacgatctttgcggcctcagcccactgagctaaagtattcatggaaaacatggggtaaagcaaaaatgctctccacagagtcttataaccaaacctttctcattgatggccccgagacggcagagtgccccaacacaaatagagcttggaactcgttggaggttgaagactacggctttggagtgttcactaccaatatatggctaaaattgaaagaaagacaggatgcattctgcgactcaaaactcatgtcagcggccataaaagacaacagagccgtccatgccgacatgggttactggatagaaagtgcactcaatgacacatggaagatagagaaagcctctttcattgaagtaaaaaactgccactggccaaaatcacacaccctctggagcaatggagtgctagaaagtgagatgataattccaaagaatctcgctggaccagtgtctcaacacaactatagaccaggctaccatacacaaatagcaggaccatggcacctaggcaagcttgagatggactttgatttctgcgatggaaccacagtgatagtgactgaggactgcggaaatagaggaccctctttgagaacaactactgcctccggaaaactcataacagaatggtgctgccgatcttgcacattaccacccctaagatacagaggtgaggatgggtgctggtacgggatggaaatcagaccattgaaagagaaagaagaaaatctggttaactccttggtcacagccggacatgggcaggttgacaatttttcactgggagtcttgggaatggcattgttcctggaggaaatgcttaggacccgagtaggaacgaaacatgcaatactactagttgcagtttcttttgtgacattgatcacagggaacatgtccttcaaagacctaggaagagtggtggttatggtaggcgccaccatggcggatgacataggtatgggcgtgacttatcttgccctactagcagccttcaaagttagaccaacttttgcagctggactactcttgagaaagctgacctccaaggaattgatgatgactaccataggaattgtactcctctcccaaagcaccataccagagaccgttcttgaattgactgatgcgttagccttaggcatgatggtccttaaaatagtaagaaacatggaaaagtatcaattggcagtgactatcatggctatcttgtgcgtcccaaacgcagtgatattacaaaatgcatggaaagtgagttgcacaatactggcagtggtgtccgtttccccactgcttttgacatcctcacagcaaaaaacggattggataccattagcattgacaatcaagggtctcaatccaacagccatttttctaacaaccctctcaagaactaacaagaaaagaagctggccactaaatgaggctatcatggcagtcggaatggtgagcattttagccagttccctcctaaaaaatgatattcccatgacaggaccactagtggctggaggactcctcactgtgtgctacgtgctcactggacgatcggccgacttggaactggagagagcaaccgatgtcaaatgggaagaccaggcagagatatcaggaagcagtccaatcctgtcaataacaatatcagaagatggtagcatgtcgataaaaaatgaagaggaagaacaaacactgaccatactcattagaacaggattgctggtgatctcaggactttttcctatatcaataccaatcacggcagcagcatggtacctgtgggaagtgaagaaacaacgggccggagtattgtgggacgttccttcacccccacccatgggaaaggctgaactggaagatggagcctacagaatcaagcaaaaagggatccttggatactctcagatcggagctggagtttacaaagaaggaacatttcatacaatgtggcatgtcacacgtggcgctgttctaatgcataaaggaaagaggattgaaccctcatgggcggacgtcaaaaaagatctaatatcatatggaggaggatggaagttagaaggagaatggaaggaaggagaagaagtccaggtgctggcactggagccgggaaaaaatccaagagccgtccaaacaaaacctggccttttcaaaaccaacaacggaacaataggtgccgtatctttggacttctcccctggaacgtcaggatctccaatcattgacaaaaaaggaaaagttgtgggtctttatggtaatggagttgtcacgaggagtggagcatatgtgagtgccatagcccaaactgaaaaaagcattgaagacaaccccgagatcgaagatgacattttccgaaagagaagactgaccatcatggacctccacccaggagcgggaaagacgaaaagataccttccagccatagtcagagaagccataaaacggggtttgagaacattaatcttggcccccactagagttgtggcagctgaaatggaggaagctctcagaggacttccaataagataccaaaccccagccatcagagctgagcacactgggcgggaaattgtggatctaatgtgtcatgccacatttaccatgaggctgctatcaccagttagagtgccaaactacaacttgattatcatggacgaagcccatttcacagacccagcaagtatagcagctagaggatacatctcaacccgagtggagatgggtgaggcagctgggattttcatgacagccactcccccaggaagtagagatccatttccccagagcaatgcaccaatcatagatgaagaaagagaaatccctgaacgttcatggaattctggacatgagtgggtcacggattttaaagggaagactgtttggttcgttccaagcataaaagcaggaaatgatatagcagcttgcctgagaaaaaatggaaagaaagtaatacaactcagtaggaagacttttgattctgagtatgtcaagacaagaaccaatgattgggatttcgtggttacaactgacatttcagaaatgggtgccaatttcaaagctgagagggttatagaccccagacgctgcatgaaaccagtcatactaacagatggtgaggagcgggtgattctggcaggacccatgccagtgacccactctagtgcagcacaaagaagagggagaataggaagaaatccaaaaaatgaaaatgaccagtacatatacatgggagaacctctggaaaatgatgaagactgtgcacactggaaagaagccaaaatgctcctagataacattaacacaccagaaggaatcattcctagtatgtttgaaccagagcgggaaaaagtggatgccattgatggcgaataccgtttgagaggagaagcaaggaaaacctttgtggacttaatgaggagaggagacttaccagtctggttggcttacaaagtggcagctgaaggcatcaactatgcagacagaaggtggtgttttgatggaattaagaacaaccaaatcctggaagaaaatgtggaagttgaaatctggacaaaagaaggggaaaggaagaaattgaaacccagatggttggatgctaggatctactctgacccactggcgctaaaagaattcaaagaatttgcagccggaagaaagtctctgaccctgaacctaatcacagaaatgggcaggcttccaacattcatgactcagaagacaagagacgcactggacaacctagcagtgctgcacacggctgaagcaggtggaagggcgtacaatcatgctctcagtgaactgccggagaccctagagacactgcttttactgacacttctggctacagtcacaggagggatctttttattcttgatgagtgggaggggcatagggaagatgaccctgggaatgtgctgcataattacggctagcatccttctatggtacgcacaaatacagccacactggatagcagcttcaataatactggagttttttctcatagttttgcttattccagaaccagaaaaacagagaacaccccaagacaaccaattgacctacgttgtcatagccatccttacagtggtggccgcaaccatggcaaacgagatgggtttcctagaaaaaacgaagaaagatcttggattaggaagcattgcaacccagcaccccgagagcaacatcctggacatagatctacgtcccgcatcagcttggacgctgtatgccgtggctacaacattcattacaccaatgctgagacatagcattgagaattcctcagtgaatgtatccctaacagctatagccaaccaagcaacagtgttaatgggtctagggaaaggatggccattgtcaaagatggacatcggagttccccttctcgccattggatgttactcacaagtcaaccccataactctcacagcagctcttctcttattggtagcgcattatgccatcatagggccaggacttcaagcaaaagcaaccagagaagcccagaaaagagcagcggcgggcatcatgaaaaacccaaccgtcgatggaataacagtgattgatctagatccaataccttatgatccaaagtttgaaaagcagttgggacaagtaatgctactaatcctctgcgtgactcaggtattgatgatgaggactacatgggctctgtgtgaggccttaaccttagctacggggcccatctccccactgtgggaaggaaatccaggaaggttctggaacactaccattgcggtgtcaatggctaacatctttagagggagttacttggctggagctggacttctcttttccataatgaagaacacaaccaacacaagaaggggaactggcaacataggagagacgcttggagaaaaatggaaaagccgattgaacgcactgggaaaaagtgaattccaaatctacaagaaaagtggaatccaggaagtggatagaaccttagcaaaagaaggcatcaaaagaggagaaacggaccatcacgctgtgtcgcgaggctcagcaaaactgagatggttcgttgagagaaacatggtcacaccagaagggaaagtagtggacctcggttgtggcagaggaggctggtcatactactgtggaggactaaaaaacgtaagagaagtgaaaggcctaacaaaaggaggaccaggacacgaagaacccatccctatgtcaacatatgggtggaatctagtgcgtcttcagagtggagttgacgtcttcttcatcccgccagaaaagtgtgatacattgttgtgtgacataggggagtcatcaccaaatcccacagtggaagcaggacgaacactcagagtccttaatttagtagaaaactggttgaacaaccacactcatttttgcataaaagttctcaacccatatatgccctcagttttagaaaaaatggaagcactgcaaaggaaatatggaggagccttagtgagaaatccactctcacggaactccacacatgagatgtactgggtatccaatgcttctgggaacatagtgtcatcagtgaacatgatttcaaggatgttgatcaatagattcacaatgagacacaagaaagccacttacgagccggatgttgacctcggaagcggaacacgtaacattggaattgaaagtgaaataccaaacctagacataattgggaaaagaatagaaaaaataaagcaagagcatgaaacatcatggcactacgaccaagaccacccatataaaacgtgggcataccatggtagctatgaaacaaaacagactggatcagcatcatccatggtcaacggagtggtcaggctgctgacaaaaccctgggacgtcctccccacggtgacacagatggcaatgacagacacgactccatttggacaacagcgtgtttttaaagaaaaagtggacacgagaacccaagaaccgaaagaaggcacgaagaaactaatgaaaatcacagcagagtggctgtggaaagaattagggaagaaaaagacacctaggatgtgcaccagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgagacatgtgtgtacaacatgatgggaaaaagagaaaagaaactaggggaatttggcaaggcaaaaggcagcagagccatatggtacatgtggcttggagctcgcttcctggagtttgaagccctaggattcctaaatgaagatcactggttctctagagagaactccctgagtggagtggaaggagaagggctgcacaagctaggttacattctaagagacgtgagcaagaaagagggaggagccatgtacgccgacgacacagcaggatgggacacaagaatcacactagaagacctaaaaaatgaagaaatggtaacaaaccacatggaaggagaacacaagaaattggccgaggctattttcaaactaacgtatcaaaacaaggtggtgcgtgtgcaaagaccaacaccaagaggcacagtaatggacatcatatcgagaagagaccaaagaggtagtgggcaagttggtacctatggactcaatactttcaccaatatggaagcccaattaatcagacagatggagggagaaggagtctttaaaaacatccagcgcctgacagtcacagaagaagttgctgtgcataactggctggcaagagtggggcgcgaaaggttgtcaagaatggccatcagtggagatgattgtgttgtgaaacctttagatgacaggttcgcaaacgctttgacagctctaaatgacatgggaaagattagaaaagacatacaacaatgggaaccttcaaaaggatggaacgattggacacaagtgcccttctgttcacaccatttccatgagctaatcatgaaggatggtcgtgtacttgttgttccatgtagaaaccaagatgaactgattggcagagcccgaatctcccaaggagcagggtggtctttgcgggagacggcctgtttggggaagtcttacgctcaaatgtggagcttgatgtatttccacaggcgtgacctcaggctggcggcaaatgccatttgctcggcagtgccatcacactgggttccaacaagtcgaacaacctggtccatacacgccaaacatgaatggatgacaacggaagacatgctgacagtctggaacagggtgtggattcgagaaaacccatggatggaagacaaaaccccagtggaatcatgggaggaaatcccatacttgggaaaaagagaagaccaatggtgcggctcattgattgggttaacaagcagggccacatgggcaaagaacatccaagcagcaataaatcaggttagatctcttataggcaatgaggaatacacagattacatgccatccatgaaaagattcagaagagaagaggaagaagcaggagtcctgtggtaa

SEQ ID NO: 6361 - RNA, 9876 nt, synthetic construct
  misc_feature 1..9876: note = derived and/or modified CDS sequence (wt) from DENV-2__AB189122__SS-prME
  source 1..9876: mol_type = other RNA
actgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatatttccaaagagtcctgattttcatcttactgacagctgtcgctccttcaatgacaatgcgctgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaactacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagagcctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacactgtacttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaagactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagtatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagtcggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacactggaaccataggcgccgtatctctggacttttctcctggaacctcaggatctccaatagttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattaaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcatgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggtgattctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaaccttcatcacaccaatgttgagacacagcattgaaaattcctcagtgaatgtgtctctaacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcattatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccaggtctataagaaaagtggaatccaggaggtggatagaaccttagcaaaagaaggcatcgaaagaggagaaacggaccatcacgctgtgtcgcgaggctcggcgaaactgagatggttcgtcgagagaaacctggtcacaccagaagggaaagtagtggacctcggttgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaacaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaagcagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 6362 - RNA, 9876 nt, synthetic construct
  misc_feature 1..9876: note = derived and/or modified CDS sequence (wt) from DENV-2__AB189123__SS-prME
  source 1..9876: mol_type = other RNA
actgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatattttcaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaacaacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcattcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtcttagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaggactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagcatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacaccggaaccataggcgccgtatctctggacttttctcctggaacctcaggatctccaatcgttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattgaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcacgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggttatcctggcaggacccatgccagtgacccactctattgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacgctcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaactttcattacaccaatgttgagacacagcattgaaaattcctcagtgaatgtgtctctgacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccagatctataagaaaagtggaatccaggaggtggatagaaccttagcaaaagaaggcatcgaaagaggagaaacggaccatcacgctgtgtcgcgaggctcggcgaaactgagatgcttcgtcgagagaaacctggtcacaccagaagggaaagtagtggacctcggttgcggcagggggggctggtcatactattgtgggggattgaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaaaaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtattggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccgtggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 6363 - RNA, 9876 nt, synthetic construct
  misc_feature 1..9876: note = derived and/or modified CDS sequence (wt) from DENV-2__AB189124__SS-prME
  source 1..9876: mol_type = other RNA
actgcaggtgtaattattatgatgattccaacagtgatggcattccatttaaccacacgcaacggagaaccacacatgatcgtcagtagacaagagaaagggaaaagtcttctgtttaaaacagagaacggtgtgaacatgtgtaccctcatggccatggaccttggtgaattgtgtgaagacacaatcacttataattgtcctcttctcaggcagaatgaaccagaagacatagactgttggtgcaactctacgtctacatgggtaacttatgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaacttgggtcttgagacatccaggcttcaccataatggcagcaatcctggcatataccataggaacgacatattttcaaagagtcctgattttcatcttactgacagctgtcgctccttcaatgacaatgcgttgtataggaatatcaaatagagactttgtggaaggggtttcaggaggaagctgggttgacatagtcttagaacatggaagctgtgtgacgacgatggcgaaaaataaaccaacattggattttgaactgataaaaacggaagccaaacatcccgccactctaaggaagtattgtatagaggcaaagctgaccaacacaacaacagcatctcgctgcccaacacaaggagaacctagcctaaatgaagaacaggacaaaaggtttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcattcaggggaagagaatgcagtcggaaacgacacaggaaaacacggcaaggaaattaaagtaacaccacagagttccattacagaagcagaactgaccggctatggcactgtcacgatggaatgctctccgagaacgggcctcgactttaatgagatggtgttgctgcaaatggaaaacaaggcttggctggtgcacaggcaatggttcttagacctgccgttaccatggctgcccggagcagacacacaaggatcaaattggatacagaaggagacattggtcactttcaaaaatccccatgcgaagaaacaggatgttgttgttttaggatcccaagaaggggctatgcatacagcactcacaggggctacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgttacagaaaaagacagcccagtcaacatagaagcagaacctccattcggagacagctacatcattataggagtagaaccgggacaactgaagctcaactggtttaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtcttagtgggggtcgtgacactgtatttgggagtcatggtgcaggccgatagtggttgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagagggcatttgtggaatccgctcagtaacaagattggagaatctgatgtggaaacaaataacaccagaactgaatcacattctatcagaaaatgaggtaaaattgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcattagaagttgaggactatggctttggagtattcaccaccaacatatggctgaaactgaaagaaaggcaggatgtattttgtgactcaaaactcatgtcagcagccataaaagacaacagggccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaactacagaccaggttatcatacacaaacggcaggaccctggcatctaggtaagcttgagatggactttgatttctgcgaaggaaccacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagaaatgctcaggacccgagtaggaacgaaacatgcaatattactagttgcagtttctttcgtgacattgatcacagggaacatgtcctttcgagatttggggagagtgatggttatggtgggcgctactatgacggatgacataggcatgggcgtgacttatcttgccctattagcagccttcaaagtcagaccaacttttgcagctggactactcttgagaaagctgacctccaaggaattaatgatgaccaccataggaatcgtactcctctctcagagcaccataccagagactatacttgaactgactgacgcgctagctttggggatgatggttctcaaaatagtgagaaacatggaaaagtatcaactagcagtgactatcatggccatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtagctggagggcttctcactgtgtgttacgtgctcactggaagatcggctgatttggaactggagagagctgctgacgtaagatgggaagaacaggcagaaatatcaggaagtagtccaattctgtcaataacaatatcggaagatggtagcatgtcgataaaaaatgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctcttcaaaactaacaccggaaccataggcgccgtatctctggacttttctcctggaacctcaggatctccaatcgttgacaaaaaaggaaaagttgtgggcctttatggcaacggtgtcgtcacaaggagtggaacatatgtgagtgccatagcccagactgaaaaaaacattgaagacaatccagagattgaagatgacatctttcgaaagaaaagattgaccatcatggacctccacccaggagcgggaaaaacgaagagataccttccagcaatagtcagagaagccataaaacgaggcttgaggacactaatcctggcccccactagagttgtggcggctgaaatggaagaagctctcagaggacttccaataagatatcaaaccccagctatcagagccgagcacactgggcgggagattgtggatctaatgtgtcacgccacatttaccatgaggctgctgtcaccaattagagtaccaaattacaacctgatcatcatggatgaagcccatttcacagacccagcaagcatagcagctagaggatatatttcaactcgagttgagatgggtgaagcagctgggattttcatgacagctactcctcctggaagcagagacccatttcctcagagcaatgcaccaatcatggatgaagaaagggaaatccctgagcgttcgtggaattctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccaggcgctgcatgaaaccagtcatactaacagacggtgaagagcgggttatcctggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagctaagatgcttctagataacatcaacacgcctgaaggaatcattcccagcatgttcgaaccagagcgtgaaaaggtggatgccattgatggtgaataccgcttaagaggagaagcgaggaaaacttttgtggacctaatgagaagaggagacctaccagtctggctagcctacagagtggcagctgaaggtatcaactacgcagacagaagatggtgctttgatggagtcaaaaacaaccaaatcttggaagaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaacgcattagacaacttagcagtcctgcatacggctgaagcaggcggaagggcgtacaatcatgctcttagtgaactgccggagaccctggagacattgcttttactgacgctcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggagttttttctcatagtcttgctcattccagaaccagaaaagcagagaacaccccaagataaccaattaacttatgttgtcatagccatccttacagtggtggccgcaactatggcaaatgagatgggtttcctggaaaaaacaaagaaagatttcggattgggaagcattgcaacccagcaacctgagagcaacatcctggacatagatctacgtcctgcatcagcttggactctatatgctgtggcaacaactttcattacaccaatgttgagacacagcattgaaaattcctcagtgaatgtgtctctgacggccattgccaaccaagccacagtgttaatgggtcttgggaaaggatggccattgtcaaaaatggacatcggagttccccttctcgctatcgggtgctattcacaagtcaaccccataactctcacggcagcccttctcttattggtagcacattatgccatcatagggccaggactccaagcgaaagcaactagagaagctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttgtgtgaagctctaaccttagcgaccgggcccatctccacactgtgggaaggaaatccagggagattttggaatacaactattgcagtgtcaatggctaacatttttagagggagttacttggccggagccggacttctcttttctatcatgaagaacacggctaatacaagaaggggaactggcaacacaggagagacgcttggagaaaaatggaaaaaccgattgaatgcattggggaagagtgaattccagatctataagaaaagtggaatccaggaggtggatagaaccttagcaaaagaaggcatcgaaagaggagaaacggaccatcacgctgtgtcgcgaggctcggcgaaactgagatggttcgtcgagagaaacctggtcacaccagaagggaaagtagtggacctcggttgcggcagggggggctggtcatactattgtgggggattgaagaatgtaaaagaagtcaaaggcctaacaaaaggaggaccaggacacgaagaacccattcccatgtcaacatatggttggaatctggtgcgtcttcaaagtggagttgatgttttttttactccgccagaaaagtgtgacacgttgctgtgtgacataggggagtcgtcaccaaaccccacggttgaggcaggacgaacactcagagttctaaacctagtggaaaattggctgaaaaacaacacccagttttgcataaaggttctcaacccatatatgccctcagtcatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgcaacatcggaattgaaagtgagataccaaatttagacataattgggaaaagaatagaaaagataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggatgtcatccctatggtgacacagatggcaatgactgacacgactccatttggacaacagcgcgttttcaaagagaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagatagtggattttgggaactggttgacaaggaaaggaatcttcatcttgaaggaaagtgtgagacatgtgtgtacaacatgatgggaaagagagagaagaagctaggggagttcggcaaagcaaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagcaagaaagaaggaggagcaatgtacgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagcggacaagttgtcacgtacggccttaatactttcaccaacatggaagcccaactgatcagacagatggagggagaaggagtcttcaaaagcatccagcacctgacagtcacagaagaaattgcagtaaaaaactggttagcaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgtagaaaccaagatgaactgattggtagggcccgaatttcccagggagccgggtggtctttgcgggaaacagcctgtttggggaagtcttatgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagatatgctgacagtctggaacagggtgtggattcaagaaaacccgtggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaaggttcagaagagaagaggaagaggcaggagtcttgtggtag

SEQ ID NO: 6364 - RNA, 9876 nt, synthetic construct
  misc_feature 1..9876: note = derived and/or modified CDS sequence (wt) from DENV-2__AB122020__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggctttaccataatggcagcaatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacctccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcatcacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaggagaacttggtcaactccttggtcacagccggacatgggcagattgacaacttttcactaggagtcttgggaatggcactgttcctggaagaaatgcttaggacccgagtaggaacgaaacatgcaatactgctagttgcactatcttttgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggtcctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacaatcatgctctcagtgaactgccggagaccctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaagcaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctaggatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaagtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggcacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaacatccagacagcaataaatcaagtcagatcccttataggcaatgaggaatacacagactacatgccatccatgaagagattcagaagggaagaggaagaggcaggtgtcctgtggtag

SEQ ID NO: 6365 - RNA, 9876 nt, synthetic construct
  misc_feature 1..9876: note = derived and/or modified CDS sequence (wt) from DENV-2__LC121816__SS-prME
  source 1..9876: mol_type = other RNA
actgtaggcatgatcatcatgctgattccaacagcaatggcgttccatttaaccacacgcaatggagaaccacacatgatcgtcagcagacaagagaaagggaaaagtctcttgtttaaaacagaggatggtgtgaacatgtgtaccctcatggccatggaccttggtgaactgtgtgaagacacagtcacttataactgtcctcttctcaggcagaatgaaccagaagacatagactgctggtgcaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagaggattgaaacctggatcttgagacatccaggttttaccataatggcagcaatcttggcacacaccataggaacaacatatttccaaagagtcttgattttcatcttactgacagctgtcgctccttcaatgacaatgcgctgcataggaatatcaaacagagactttgtggaaggggtttcaggaggaagctgggttgacatagtcttagaacatggaagctgtgtgacaacgatggcaaaaaacaaaccaacattggactttgagctgataaaaacagaagccaagcaacctgccactctaaggaagtactgtatagaggcaaagctgaccaacacaacaacagcatctcgatgcccaacacaaggggaacccagtctaaacgaagagcaggacaaaaggtttgtctgcaaacattccatggtagacagaggatggggaaatggatgtggattatttggaaaaggaggcatcgtgacctgtgccatgttcacatgcaaaaaaaacatggaagggaaaatcgtgcaaccagaaaacctggaatacaccattgtgataacacctcactcaggggaagagaatgcagttggaaatgacacaggaaaacatggcaaggaagtcaaagtaacaccacagagttctattacagaagcagaactgacaggctatggcaccgtcacgatggagtgctctccgagaacgggccttgacttcaatgagatggtgttgctgcaaatggaaaacaaagcttggttggtgcacaggcaatggttcttagacctgccgttaccatggctgcccggagcggacacacaaggatcaaattggatacagaaggagacattggtcaccttcaaaaatccccatgcaaagaaacaggatgttgttgttttaggatctcaagaaggggctatgcatacagcacttacaggggccacggaaatccaaatgtcatcaggaaacctactgttcacaggacatctcaagtgcaggctgagaatggacaaactacagctcaaaggaatgtcatactctatgtgtacaggaaagtttaaagttgtaaaggaaatagcagaaacacaacatggaacaatagttatcagagtacaatatgaaggggatggttctccatgtaaaatcccttttgagataatggacctggaaaaaagacatgtcttaggtcgcctgattacagtcaacccaattgtcacagaaagagacagcccagtcaacatagaagcagaacctccatttggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaggtttttggagcaatctatggggctgccttcagcggggtctcatggaccatgaaaatcctcataggagttgtcatcacatggataggaatgaattcacgcagcacctcactgtctgtgtcgttagtattagtgggagttgttacattgtatttgggagtcatggtgcaggctgatagtggttgtgttgtgagttggaaaaacaaagaactgaaatgtggcagcgggatctttatcacagacaatgtacacacatggacagaacaatacaaattccaaccagaatccccctcaaagctggcttcagccattcaaaaagcttatgaagagggcatttgtggaatccgctcagtaacaagactggagaatctaatgtggaaacaaataactccagaactgaaccacattctatcagaaaatgaggtaaagttgactatcatgacaggagacatcaaaggaatcatgcaggcaggaaagcggtccctgcggcctcagcccactgagctgaagtattcatggaaaacatggggcaaagcgaaaatgctctccacagagcaccataaccagacccttctcattgatggccccgaaacagcagaatgtcccaacacaaacagagcttggaactcactagaagttgaagactatggctttggggtattcaccaccaatatatggctgaagttgaaagaaaggcaggatgtgttttgtgactcaaaactcatgtcggcagccataaaagacaacagagccgtccatgccgatatgggttattggatagaaagcgcgcttaatgacacatggaagatagaaaaagcctccttcatcgaagttaaaagctgccactggccaaaatcacacactctctggagtaatggagtgctagaaagtgagatgataattccaaagaattttgctggaccagtatcacaacacaattacagaccaggctatcacacacaaacggcaggaccctggcatctaggcaagcttgagatggactttgatttttgtgaaggaaccacagtggtggtgactgaggactgtggaaatagaggaccctctctaagaacaactaccgcttctggaaaactcataacagaatggtgttgccgatcctgcacattaccaccgctaagatacagaggcgaggatggatgttggtacggaatggaaatcagaccattgaaagagaaagaagagaacctggtcaactctttggtcacagccggacacggacagattgacaacttctcgttaggagtcttgggaatggcattgttcctggaagaaatgctcaggacccgagtaggaacaaaacatgcattattactagttgcagtttctttcatgacattaatcacagggaatatgtctttccgagacctggggagagtgatggttatggtgggggctgctatgacggacgacataggcatgggcgtgacttatcttgccttattagcagccttcaaagttagaccaacttttgcagctggactacttttaagaaagctgacctccaaggaattgatgatgaccaccataggaattgtacttctctcccagagcaccataccagagactatacttgaactgactgatgcgttggccttaggcatgatgattctcaaaatagtgagaaatatggagaagtatcaattagcagtgactatcatggctattttatgtgttccaaatgcagtgatactacaaaatgcatggaaagtgagctgcacaatactggcagtggtgtccgttaccccactgctcttaacatcctcacggcagaaagcggactggataccattggcattgacgatcaagggtctcaatccaacagccattttcttaacaaccctttcaagaaccaacaagaaaaggagttggccactaaatgaggctatcatggcagtcgggatggtgagcattttagccagttctctcctgaagaatgacattcccatgacaggaccactagtggctggagggcttctcactgtgtgttacgtgctcactggaagatcggctgatttggaactggagagagccgctgacgtaagatgggaagatcaagcagagatatcgggaagtagtccaattctgtcaataacaatatcggaagatggcagcatgtcaataaaaaatgaagaagaagaacaaacactgaccatcctcattagaacaggattgctggtgatatcaggactttttcccgtatcaataccaattacggcagcagcatggtacctgtgggaagtgaagaaacaacgggctggagtgttgtgggatgttccttcacccccacccgtgggaaaggccgaattggaagatggagcctatagaatcaagcagaaagggattcttggatactcccagatcggagctggagtctacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggttttggcattggagcctggaaagaatccaagagccgtccaaacaaaacccggtctttttaagactgacaccggaaccataggcgccgtatctctagacttttctcctggaacgtcaggatctccaatcgtcgacaaaaaaggaaaagtcgtgggtctttatggtaatggagttgtcactagaagtggaacatatgtgagcgccatagcccagactgaaaaaagcattgaagacaacccagagattgaagatgacatctttcggaaaagaagattgaccattatggacctccacccaggagcgggaaagacgaaaagataccttccagcaatagtcagagaggccataaaacgaggcttgagaacattaatcctggcccctactagagtcgtggcagctgaaatggaggaagctcttagaggacttccaataagataccaaaccccagccattagagctgagcacactgggcgagaaatcgtggatttaatgtgtcatgccacatttaccatgaggctgctgtcgccagttagagtgccaaattacaacctgatcattatggatgaagcccatttcacagacccagcgagcatagcagctagaggatacatttcaactcgagtagagatgggtgaagcagctgggatttttatgacagccactcctccgggaagcagagacccatttcctcagagcaacgcaccaatcatggatgaggaaagggaaatccctgaacgttcgtggaattctggacatgaatgggttacggattttaaagggaagactgtttggtttgttccgagtataaaagcaggaaatgatatagcagcttgtctgagaaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaagccagtcatactaacagacggtgaagagagggtgatcttggcaggacccatgccagtaacccactctagtgcagcacaaagaagagggagaataggaaggaatccaaaaaatgaaaatgaccaatacatatacatgggggaacctctggaaaatgatgaagactgtgcacactggaaagaagctaagatgcttctagacaacatcaacacgcctgaaggaatcatccccagcatgtttgaaccagagcgtgagaaggtggatgccattgatggtgagtaccgcttaagaggagaagccaggaaaacctttgtggacctaatgagaagaggagacctaccagtctggctggcctacagagtggcagccgaaggcattaactatgcagacagaaggtggtgttttgatggagtcaagaacaaccaaatcttggaagaaaatgtggaagtggaaatctggacaaaagaaggagaaaggaagaaattgaaacccaggtggttggatgctaggatctattctgacccgctggcgctcaaagaattcaaagagtttgcagccggaagaaaatccctgaccctgaatctaatcacagaaatgggtaggcttccaacttttatgacccagaaagcaaggaatgcactggacaacttagcagtcctgcacacagctgaagcaggcggaagagcatacaaccatgctctcagtgaactgccggagaccctggagacattgcttttgctgacacttttggctacagtcacgggcggaatctttctatttttgatgagcggaaaaggtatagggaaaatgactctgggaatgtgctgcataatcacggccagtattctcctatggtacgcacagatacagccacactggatagcagcttcaataatactggagttttttctcatagttttgctcattccagaaccagaaaagcagagaacaccccaagacaaccaattaacttacgttgtcatagccatcctcacagtggtggccgcaaccatggcaaacgagatgggttttctggaaaaaacgaagaaagatttcggattgggaagcattgcaacccagcagcccgagagcaacatcctggacatagatctacgccctgcatcagcatggaccctgtatgccgtggccacaacatttatcacaccaatgctgagacatagtattgaaaattcctcagtgaatgtgtctctaacagccattgccaaccaagccacagtactaatgggtcttgggaaaggatggccattgtcaaaaatggatattggagttcctcttctcgctattgggtgctattcacaagtcaaccccataactcttacagcagcccttcttttattggtagcacattatgctatcatagggccaggactccaagcgaaagcaaccagagaagcgcagaaaagagcagcagcaggcatcatgaaaaacccaactgtggatggaataacagtgattgacctagacccaataccctatgatccaaaatttgagaaacagctgggacaagtgatgctcctagtcctctgcgtgactcaagtactgatgatgaggactacatgggctttgtgtgaggctctaaccttagcgaccgggcccatttccacattgtgggaaggaaatccagggagattttggaatacaactattgcagtgtcaatggctaacatttttagaggaagttacttggctggagctggacttctcttttccatcatgaagaacacaaccaacacaagaaggggaactggcaacacaggagagacgcttggagagaaatggaaaaaccgattgaacgcattagggaagagtgaattccagacttacaagaaaagcggaatccaggaagtggatagaaccttggcaaaagagggcatcaaaagaggagaaacagaccatcacgctgtgtcgcgaggctcagcaaagctgagatggttcgtcgagagaaacctggtcacaccagaagggaaagtagtggacctcggttgcggcagagggggctggtcatactattgtgggggcctaaagaatgtaagagaagtcaaaggcctaacaaaaggagggccaggacatgaagaacctattcccatgtcaacatatgggtggaatctagtgcgtcttcaaagtggagttgacgttttctttaccccgccagaaaaatgtgatacattgttgtgcgacataggggagtcgtcaccaaatcccacggttgaagcaggacgaacactcagagtcctaaacttggtggaaaattggctgaacaacaacacccaattttgcataaaggttctcaacccatacatgccctcagtcatagagaaaatggaagcgctgcaaaggaaatacggaggggctttggtgaggaatccactctcaagaaattccacacatgagatgtattgggtatccaatgcttccgggaacatagtgtcatcagtgaacatgatttcaaggatgttgatcaacagattcacaatgagacataagaaggccacatacgagccagatgttgacctcggaagcggaacccgcaacatcggaattgaaagtgagacaccaaacctagacataattggaaaaagaatagaaaaaataagacaagagcatgaaacatcatggcactatgatcaagaccacccatataaaacgtgggcctaccatggcagctacgaaacaaaacagactggatcagcatcatccatggtgaatggagtggttagactgctgacaaaaccttgggacgtcatccccatggtgacacagatggcaatgacagacacgaccccatttggacaacagcgtgtttttaaagagaaagtggacacgagaacccaagaaccaaaagaaggcacgaagaaactaatgaaaatcacagccaaatggctctggaaggaattagggaagaaaaagacacctaggatgtgcactagagaagaattcacaagaaaggtgagaagcaacgcagccctaggtgccatattcactgatgagaacaagtggaagtctgcacgtgaggctgttgaagacagtagattttgggaactggttgacaaggaaaggaatctccatcttgaaggaaagtgtgaaacatgtgtgtacaatatgatgggaaagagagagaagaaactaggggagttcggcaaagcaaaaggcagtagagccatatggtacatgtggcttggagcacgcttcttggagtttgaagccctaggattcttgaatgaagatcattggttttctagagagaactctttgagtggagtggaaggagaagggctgcacaagctgggttacatcctaagagatgtgagcaagaaagaaggaggagcaatgtacgccgatgacactgcaggatgggacacaagaatcacactagaggacttaaaaaatgaagaaatggtgacaaaccacatggaaggagaacacaagaaacttgctgaggccatcttcaaattaacgtaccaaaacaaggtggtgcgtgtgcaaagaccgacaccaagaggcacagtaatggatattatatcaagaagagaccaaagaggaagtggacaagttggcacctatggcctcaacactttcaccaatatgggagcccaattaatcagacagatggagggagaaggagtctttaaaagcatccagcacctgacagctacagaagaaatcgcagtgcaagactggttagcaagagtggggcgtgagaggttatcaagaatggctatcagtggagatgattgtgttgtgaaacccttagatgacaggtttgcaagtgctttaacggctctaaatgacatgggaaaggttaggaaagatatacaacaatgggaaccttcaagaggatggaacgattggacacaggtgcctttctgttcacaccatttccatgagttaatcatgaaagatggtcgtgtactcgttgttccatgtagaaaccaagatgaactgattggcagagcccgaatttcccagggagccgggtggtctttgcgggagacggcctgtctgggaaagtcttacgcccaaatgtggagcctgatgtactttcacagacgtgacctcagactggcggcaaacgctatttgctcggcagtcccatcacactgggttccaacaagtcgaacaacctggtccatacatgccaaacatgaatggatgacaacagaagacatgctgacggtctggaacagggtgtggattcaagaaaacccatggatggaagacaaaactccagtggaatcatgggaggaaatcccatacttgggaaaaagagaagaccaatggtgcggctcattgatagggctaacaagcagggctacctgggcaaagaacatccaaacagcaataaaccaagtcagatccttaataggcaatgaggagtacacagactatatgccatccatgaaaagattcagaagagaagaggaagaggcaggggtcttgtggtag

SEQ ID NO: 6366 - RNA, 9876 nt, synthetic construct
  misc_feature 1..9876: note = derived and/or modified CDS sequence (wt) from DENV-2__LC111438__SS-prME
  source 1..9876: mol_type = other RNA
actgcaggtataattattatgatgattccaacagtgatggcgttccatttaaccacacgcaacggagaaccacacatgatcgtcagcagacaagagaaggggaaaagtcttctgtttaaaacagagaacggtgtgaacatgtgtaccctcatggccatggaccttggtgagttgtgtgaagacacaatcacttataattgtcctcttctcaggcaaaatgaaccagaagacatagactgttggtgcaactctacgtctacatgggtgacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttgggtcttgagacacccaggcttcaccataatggcagcaatcctggcatacaccataggaacgacacatttccaaagagtccttattttcatcttactgacagctgtcgctccctcaatgacaatgcgttgtataggaatatcaaatagagactttgtggaaggggtttcaggaggaagctgggttgacatagtcttggaacatggaagctgtgtgacgacgatggcgaaaaataaaccaacattggattttgaactgataaaaacagaagccaaacatcccgccactctaaggaagtattgtatagaggcaaagctgactaacacaacaacagcatctcgctgcccaacacaaggagaacctagcctaaatgaagaacaggacaaaagatttgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggcctcgacttcaatgagatggtgttgctgcagatggaaaacaaggcttggctggtgcacaggcaatggttcttagacctgccgttaccatggctgcccggagcagacacacaaggatcaaactggatacagaaggagacattggtcactttcaaaaatccccatgcaaagaaacaggatgttgttgttttgggatcccaagaaggggctatgcatacagcactcacaggggccacggaaatccagatgtcatcaggaaacttactgttcacaggacatcttaagtgcaggctgagaatggacaaactacagctcaaaggaatgtcatattctatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgtttaattacagtcaacccaattgttacggaaaaagacagcccagtcaacatagaagcagaacctccatttggagacagctacatcattataggagtagaaccgggacaactgaagctcagctggtttaagaaaggaagttccattggccaaatgtttgagacaacaatgagaggagcgaagagaatggccattttaggtgacacagcttgggatttcggatccctgggaggagtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggcagtgggatttttatcacagacaacgtgcacacatggacagaacaatacaaattccaaccagaatctcctccaaagctggcttcagctatccagaaggctcatgaagagggcatttgtggaatccgctcagtaacaagactggagaatctgatgtggaaacaaataacaccagaattgaatcacattctatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaattcactagaagttgaagactacggctttggagtattcaccaccaacatatggctgaaattgaaagaaaagcaggatgtattttgtgactcaaaactcatgtcagcagccataaaagacaacagagccgtccacgccgatatgggttattggatagaaagcgcactcaatgacacatggaagattgagaaagcctcttttattgaagtcaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggtagtcttgagatggactttgatttctgcgaaggaaccacagtggtagtgactgaggactgtggaaacagaggaccctctttaagaacaaccactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacacggacagattgacaacttctcactaggagtcttgggaatggcactgttcctggaagagatgctcaggacccgagtaggaacgaaacatgcaatattactagttgcagtttctttcgtgacattgatcacagggaacatgtcctttcgagatttggggagagtgatggtcatggtgggcgctactatgacggatgacataggcatgggcgtgacttatcttgccctattagcagccttcaaaatcagaccaacttttgcagctggactactcttaagaaagctgacctctaaggaattgatgatgaccaccataggaatcgtactcctctctcagagcaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaatgcatggaaagtgagctgcacaacactggcagtggtgtccgtttccccactgcttttaacatcctcacagcagaaagcagattggataccactggcgttgacgatcaaaggccttaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggagagagctgctgacgtaagatgggaagaacaggcagagatatcaggaagcagtccaattctgtcaataacaatatcggaagatggtagcatgtcgataaaaaatgaagaagaagaacaaacactgaccatactcattagaacaggactgctggtgatatcaggactttttcccgtgtcaataccaatcacggcagctgcatggtacctgtgggaagtgaaaaaacaacgagccggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagacctaatatcatatggaggaggctggaagctagaaggagaatggaaggaaggagaagaagtccaggtcctggcattagagcctggaaagaatccaagagccgtccaaacaaaacccggtctttttaaaactaacactggaaccataggtgccgtatctctggacttttctcctggaacgtcaggatctccaatcgtcgacaaaaaaggaaaagttgtgggcctttatggcaacggtgtcgtcacaaggagtggaacatatgtgagtgccatagcccagactgaaaaaagcatcgaagacaatccagagattgaagatgacatctttcgaaagaaaagattgaccatcatggacctccacccaggagcgggaaaaacaaagagataccttccagcaatagtcagagaagccataaaacgaggcttgagaacactaatcctggcccccaccagagttgtggcagctgaaatggaagaagctctcagaggacttccaataagataccaaaccccagctatcagagctgagcacactgggcgggagattgtggatctaatgtgtcacgccacatttaccatgaggctgttatcaccaattagagtgccaaattacaacctgatcatcatggatgaagcccatttcacagacccagcaagcatagcagccagaggatacatttcaactcgagtagagatgggtgaagcagctgggattttcatgacagctactcctcctggaagcagagacccatttcctcagagcaatgcaccaatcatggatgaagaaagggaaatccctgagcgttcgtggaactctggacatgagtgggtcacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatactaacagacggcgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcacactggaaagaagcaaagatgcttctagataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttggatgctaggatctactctgacccattggcgctcaaagaattcaaggaattcgcagctggaagaaaatccctggccctgaatctaatcacagagatgggtaggctcccaaccttcatgacccagaaagcaaggaatgcactggacaacttagcagtcctgcacacggctgaagcaggcggaagggcatacaatcatgctcttagtgaactgccggagaccctggagacattgcttttactgacacttttggccacagtcacgggcggaatcttcctgttcttaatgagcggaaagggaatagggaagatgaccatgggaatgtgctgcataatcacggccagtatcctcctatggtatgcacaaatacagccacactggatagcagcttcaataatactggagttttttctcatagtcttgctcattccagaaccagagaagcagagaacaccccaagataaccaattaacttatgttgtcatagccatcctcacagtggtggccgctaccatggcaaacgagatgggtttcctggaaaaaacaaagaaagatttcggattgggaagcattgcaacccagcagcctgagagcaacatcctggacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggccttgggaaaggatggccattgtcaaaaatggacatcggagttccccttcttgctatcgggtgctattcacaagtcaaccccataactctcatggcagcccttctcttattggtagcacattatgctatcatagggccaggactccaagcgaaagcaactagagaggctcagaaaagagcagcagcgggcatcatgaaaaacccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagctaccgggcccatctctacactgtgggaaggaaatccagggagattttggaatacaactattgcagtgtcaatggctaacatttttagagggagttacttggccggagccggacttctcttttctatcatgaagaacacggccaacacaagaaggggaactggcaacacaggagagacgcttggagagaaatggaaaaaccggctgaatgcattggggaagagtgaattccagatctacaagaaaagtggaatccaggaagtggatagaaccttagcaaaagaaggcatcaaaagaggagaaacggaccatcacgctgtgtcgcgaggctcggcaaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagaacccattcccatgtcaacatatggttggaatctggtgcgtcttcaaagtggagttgatgttttttttactccgccagaaaagtgtgacacattactgtgtgacataggggagtcgtcaccaaaccccacggttgaggcaggacgaacactcagagttctaaacttagtggaaaattggctgaacaacaacacccaattttgcataaaggttctcaacccatatatgccctcagttatagaaaaaatggaagcgctacaaaggaaatacggaggagctttggtgaggaatccactctcacgaaattccacacacgagatgtactgggtatccaacgcttccgggaacatagtgtcatcagtgaacatgatttcaagaatgttgattaacagattcacaatgagacataagaaggccacatacgagccagatgttgacctcggaagcggaacccgcaacatcggaattgaaagtgagacaccaaatttagacataattgggaaaagaatagagaaaataaaacaagagcatgaaacatcatggcactatgaccaagaccatccatacaaaacgtgggcctatcatggtagctacgagacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaatcacggcaaaatggctctggaaagaactaggaaagaaaaagacgcctaggatgtgcaccagagaagaattcacaagaaaggtgagaagcaatgcagccttaggtgccatattcactgatgagaacaagtggaagtcggcacgtgaggctgttgaagatagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgtttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatagtgacaaactacatggaaggagaacacaagaaacttgctgaagccattttcaaattaacgtaccaaaacaaggtggtgcgtgtgcaaagacccacaccaagaggcacagtaatggacattatatcgagaagagaccaaagaggtagtggacaagttgtcacctacggcctcaatactttcaccaacatggaagcccaactgatcagacagatggagggagaaggagtctttaaaagcatccagcacctgacagtcacagaagaaattgcagtggaaaactggttagtaagagtggggcgtgagaggttatcaagaatggccatcagtggagatgattgtgtcgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtactcgtagttccatgtagaaaccaagatgaactgattggtagggcccgaatttcccagggagctgggtggtccttgcgggaaacagcctgtttggggaagtcctacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 6367 - RNA, 9876 nt, synthetic construct
  misc_feature 1..9876: note = derived and/or modified CDS sequence (wt) from DENV-2__KF744400__SS-prME
  source 1..9876: mol_type = other RNA
actgcaggcatgatcattatgctgatcccaacagtgatggcgttccatttaaccacacgtaacggagaaccacacatgatcgtcagtagacaagagaaagggaaaagtcttctgtttaaaacagagaatggtgtgaacatgtgtaccctcatggccatggaccttggtgaattgtgtgaagatacaatcacgtacaagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacgcgaactgaaacatggatgtcatcagaaggggcctggaaacatgcccagagaattgaaacttggattttgagacatccaggctttaccttaatggcagcaatcctggcatacaccataggaacgacacatttccaaagagccctgatcttcatcttactgacagctgtcgctccttcaatgacaatgcgttgcataggaatatcaaacagagattttgtagaaggggtttcaggaggaagctgggttgacatagtcttagaacatggaagttgtgtgacgacaatggccaaaaacaaaccaacattggattttgaactgataaaaacagaagcaaaagaacctgccactctaaggaagtactgtatagaggcaaagttaaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataactcctcattcaggggaagagcacgcagttggaaatgacacaggaaaacatggcaaggaaatcaaaataacaccacagagttccaccacagaagcagagttgacaggctatggcacagtcacgatggagtgttctccaagaacgggcctcgatttcaatgagatggtgttgttgcaaatggaaaacaaagcgtggctggtgcaccggcaatggttcctagacctgccgttgccatggctgcccggagcggacacacaaggatcaaactggatacagaaagagacattagtcactttcaaaaacccacatgcgaagaaacaagatgttgttgttttaggatcccaagaaggggccatgcacacagcacttacaggggccacagatatccagatgtcatcagggaacttactgttcacaggacacctcaagtgcaggctgaggatggacaaactacagctcaaaggaatgtcatactccatgtgcacaggaaagtttaaagttgtgaaggaaatagcagaaacacaacatggaacaatagttgtcagagtacaatatgaaggggacggttctccatgtaagattccttttgagataatggatttggaaaaaagacatgtcttgggtcgcctgattacagtcaacccaattgtgacagaaaaggatagcccagtcaacatagaagcagaacctccattcggagacagctacgtcatcataggagtggagccggggcaattgaaactgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctacggggctgccttcagcggagtctcgtggaccatgaaaatcctcataggagtcattatcacatggataggaatgaattcacgtagcacctcactgtctgtatcactagtattggtgggggtcgtgacactgtacttgggagtcgtggtgcaggccgatagtggttgcgttgtgagctggaaaaacaaagaactgaaatgtggtagtgggattttcatcacagacaacgtgcacacatggacagaacaatacaagttccaaccagaatctccttcaaaactagcttcagctatccagaaagctcatcaagagggcatttgtggaatccgctcagtaacaagactggaaaatttgatgtggaaacaaataacaccggaattgaatcacattttatcagaaaatgaggtgaagctgactatcatgacaggagatatcaaaggaatcatgcatgcaggaaaacgatctctgcggcctcagcccactgagctgaggtattcatggaagacatggggcaaagcgaaaatcctctccacagagtcccataaccagacctttctcattgatggccccgaaacagcagaatgccccaacacaaacagagcttggaattcactggaagttgaagactatggctttggagtattcaccaccaatatatggctaaagctgagagaaaagcaggatgccttttgcgacccaaaactcatgtcagcggccataaaagacaacagagccgtccatgccgacatgggttattggatagaaagtgcacttaatgacacatggaagatagagaaagcctctttcattgaagttaaaaactgccactggccaaagtcacacaccctttggagcaatggagtgctagaaagtgagatgataattccaaaaaatttcgctggaccagtgtcacaacacaactacagaccaggctaccatacacaaacagcaggaccatggcatttaggtaagcttgagctggactttgatttctgcgagggaactacagtagtggtgactgaggactgtggaaatagagggccctccttaagaacaaccactgcctctggaaaactcataacagaatggtgctgcagatcttgcacattaccaccactaagatataaaggtgaggatggatgctggtacgggatggaaattagaccattgaaagaaaaagaagagaatttggtcagctccttggtcacagccggacatgggcagattgacaacttctcactaggagtcttgggaatggcattgtttctggaagaaatgctcaggacccgagtgggaatgaaacatgcaatactactagttgcagtttcttttgtgacattaatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagtaccataccagagaccattcttgaactgactgatgctttagccttgggcatgatggtcctcaaaatagtgaggaaaatggaaaggtatcaactggcagtgactatcatggccatcttgtgcgtcccaaattcagtgatattacaaaacgcatggaaagtgagctgcacaatactggcagtggtgtccgtttccccactgcttttaacatcctcacagcagaaagcggactggataccattagcattgacgattaaaggtctcaatccaacagctatatttctaacaaccctttcacgaaccagcaagaaaaggagttggccactaaatgaggctatcatggcagtcgggatggtgagcattttagccagttcacttctaaagaatgatattcccatgacaggaccactggtggctggagggctcctcacagtgtgctacgtgctcactggacgatcggccgacctggaattggagaaagctgctgacgtcagatgggaagatcaggcagagatatcaggaagcagtccaatcctgtcagtaatagtatcagaagatggtagcatgtcaataaaaaacgaagaggaagaacaaatactgaccatactcattagaacaggattgctggtgatctcaggactttttcctgtatcaataccaattacagcagcagcatggtacctgtgggaagtgaagaaacaacgggctggagtactgtgggatgtcccttcacccccacctgtgggaaaggctgaactggaagatggagcctatagaatcaagcagaaagggattctcggatattcccagatcggagccggagtttacaaagaaggaacattccatacaatgtggcatgtcacacgtggtgctgtcctaatgcataaaggaaagaggattgagccatcatgggcggacgtcaaaaaagacctaatatcatatggaggaggctggaaattggaaggagaatggaaggaaggagaagaagtccaggtcctggcattggagcctggaaaaaatccaagagccgtccaaacaaaacctggtcttttcaaaaccaatgctggaaccataggtgccgtatctctggacttttctcctggaacgtcaggatcaccaatcattgataaaaaaggaaaggtggtgggtctttatggtaatggcgttgttacaaggaatggatcatatgtgagtgctatagcccagacggaaaaaagcattgaagacaatccagagattgaagatgacatttttcgaaagaaaagattgaccatcatggacctccacccaggagcaggaaaaacgaaaagataccttccggccatagtcagagaagccataaaacggggcctgaggacactaattctggcccccactagagttgtggcagctgaaatggaggaagctcttagaggacttccaataagataccaaaccccagccatcagagccgagcacaccgggcgggagattgtggacctaatgtgtcatgccacattcactatgaggctgctatcgccaattagagtaccaaattacaacctgattatcatggatgaagcccatttcacagacccagcaagtatagcggccagaggatacatctcaactcgagtggaaatgggtgaggcagctgggattttcatgacagccactcctccagggagcagagacccttttccccagagcaatgcaccaatcatggatgaagaaagagaaatccctgaacgttcgtggaattccggacatgaatgggttacggattttaaagggaagactgtttggttcgttccaagtataaaagcgggaaatgacatagctgcttgcctgagaaaaaatggaaagaaagtgatacaactcagcaggaaaacctttgattctgagtatgtcaagactagaaccaatgactgggactttgtggttacgactgacatttcagaaatgggtgccaacttcaaggctgagagggtcatagatcccagacgctgcatgaaaccagttatactaacagatggtgaagagcgggtgatcctggcaggacccatgccagtgacccactctagtgcagcacaaagaagagggagaataggaagaaatccaaaaaatgaaaacgaccagtacatatacatgggggaacctctggaaaatgacgaagactgtgcacactggaaagaagccaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcttggaagaaaacgtggaagtggaaatctggacaaaagaaggggaaaggaagaaattaaaacccagatggttggacgccaggatctattctgaccccctagcgctaaaagaattcaaggaatttgcagctggaagaaagtccctgaccctgaaccttatcacagaaatgggaaggcttccaactttcatgactcagaaggcaagagacgcattggataacctggcagtgctgcacacggctgaagcaggtggaagggcgtacaatcatgctctcagcgaactgccggagaccctggagacactacttttactgacacttctggctacagtcacgggaggaatctttttattcttgatgagcggaagaggtatagggaagatgaccttaggaatgtgctgcataatcacggccagcatccttctatggtacgcacaaatacagccacactggatagcagcttcaataatattggaattttttctcatagttctgcttattccagaaccagaaaagcagagaacaccccaagataaccaattaacctacgttgtcatagccatcctcacagtggtggccgcaaccatggcaaacgagatgggtttcctggaaaaaacgaagaaagatctcggattaggaagcattgcaacccagcaacccgagagcaacatcctggacatagacctacgtcctgcatcagcatggacgctgtatgccgtggctacaacattcatcacaccaatgttgagacatagcattgaaaattcctcagtgaacgtgtccctaacagctattgccaaccaagccacagtgttaatgggccttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagggaagcccagaaaagagcagcagcgggcatcatgaaaaacccaactgttgacggaataacagcaatcgacttagatccaataccctatgacccaaagtttgaaaagcagttgggacaagtaatgctcctagtcctctgtgtgactcaagtattgatgatgaggactacatgggctctgtgtgaagctttaaccctagcgaccgggcccatttccacattgtgggaaggaaatccagggaggttttggaatactaccattgcagtgtcaatggccaacatttttagaggaagttacttggctggagctggacttctcttttccatcatgaagaacacaaccaacacaagaaggggaactggcaacataggagagacgcttggagagaaatggaaaagccggttgaacgcattggggaaaagtgaattccagatctacaagaaaagtggaatccaggaagtggatagaaccttagcaaaagaaggcattaaaagaggagaaacggaccaccacgctgtgtcgcgaggctcagcaaaactgagatggttcgtcgagagaaacatggtcacaccagaagggaaagtagtggaccttggttgcggcagaggaggctggtcatactattgtggaggacttaagaatgtaagagaagtcaaaggcctgacaaaaggaggaccagggcacgaagaacccatccctatgtctacatacgggtggaacctagtgcgtcttcaaagtggagttgacgttttcttcactccgccagaaaagtgcgacacattgctgtgtgacataggggagtcgtcaccaaatcccacggtagaagcgggacgtacactcagagtcctcaacttagtggaaaattggttgaacaacaacacccaattttgcataaaggttctcaacccatacatgccctcagtcatagaaaaaatggaagcactacaaaggaaatatggaggagctttagtgaggaatccactctcacgaaactccacacatgaaatgtactgggtatccaatgcctccgggaacatagtgtcatcagtgaacatgatttcaaggatgttgatcaacagattcacaatgaagcacaagaaagccacttacgagccagatgttgacttaggaagcggaacctgcaatatcggaattgaaagtgaggtaccaaacctggacataatcgggaaaagaatagaaaaaataaaacaagagcatgaaacatcatggcactatgaccaagaccacccatacaaaacatgggcttaccatggtagctatgaagcaaaacaaactggatcagcatcatccatggtgaacggagtggtcagactgctgacaaaaccttgggacgtcatccccatggtgacacagatggctatgacagacacgactccatttggacaacagcgcgtttttaaagagaaagtggacacgagaacccaagaaccgaaagaaggcacgaagaaattaatgaaaatcacggcagaatggctttggaaagaactagggaagaaaaagacacctaggatgtgtactagagaagaattcacaagaaaggtgagaagcaatgcagccttgggggccatattcactgatgagaacaagtggaagtcggcacgtgaggctgtcgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacggtttttagagtttgaagccctaggattcttgaatgaagatcactggttctccagagagaactccctgagtggagtggaaggagaagggctgtacaagctaggctacattttaagagacgtgagcaagaaagaaggaggagcaatgtatgccgatgacaccgcaggatgggacacaagaatcacactggaagatctaaaaaatgaagaaatggtaacaaaccacatggaaggagaacacaaaaaactagctgaggctattttcaaattaacgtaccaaaacaaggtggtgcgtgtgcaaagaccaacaccaagaggcacagtaatggatatcatatcgagaagagaccaaagaggtagcggacaagttggtacctatggactcaacactttcactaacatggaagcccaactaatcagacagatggaaggagaaggaatcttcaaaagcattcaacacttgacagccacagaagaaatcgccgtgcaaaactggctaacaagagtagggcgcgaaaggttatcaagaatggccatcagtggagatgattgtgttgtgaaacccttagatgacagattcgcaagtgccttaacagctctaaatgacatgggaaaggtcaggaaagacatacaacaatgggaaccttcaagagggtggaatgattggacacaggtgcccttctgttcacatcatttccatgagttaatcatgaaagacggtcgcgtacttgtagttccatgtagaaaccaggatgaattgattggtagagcccgaatttcccagggagctggatggtctttgcgggaaacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgtggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6368 - RNA, 9876 nt, synthetic construct
  misc_feature 1..9876: note = derived and/or modified CDS sequence (wt) from DENV-2__KF744401__SS-prME
  source 1..9876: mol_type = other RNA
actgcaggcatgatcattatgctgatcccaacagtgatggcgttccatttaaccacacgtaacggagaaccacacatgatcgtcagtagacaagagaaagggaaaagtcttctgtttaaaacagagaatggtgtgaacatgtgtaccctcatggccatggaccttggtgaattgtgtgaagatacaatcacgtacaagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacgcgaactgaaacatggatgtcatcagaaggggcctggaaacatgcccagagaattgaaacttggattttgagacatccaggctttaccttaatggcagcaatcctggcatacaccataggaacgacacatttccaaagagccctgatcttcatcttactgacagctgtcgctccttcaatgacaatgcgttgcataggaatatcaaacagagattttgtagaaggggtttcaggaggaagctgggttgacatagtcttagaacatggaagttgtgtgacgacaatggccaaaaacaaaccaacattggattttgaactgataaaaacagaagcaaaagaacctgccactctaaggaagtactgtatagaggcaaagttaaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataactcctcattcaggggaagagcacgcagttggaaatgacacaggaaaacatggcaaggaaatcaaaataacaccacagagttccaccacagaagcagagttgacaggctatggcacagtcacgatggagtgttctccaagaacgggcctcgatttcaatgagatggtgttgttgcaaatggaaaacaaagcgtggctggtgcaccggcaatggttcctagacctgccgttgccatggctgcccggagcggacacacaaggatcaaactggatacagaaagagacattagtcactttcaaaaacccacatgcgaagaaacaagatgttgttgttttaggatcccaagaaggggccatgcacacagcacttacaggggccacagaaatccagatgtcatcagggaacttactgttcacaggacacctcaagtgcaggctgaggatggacaaactacagctcaaaggaatgtcatactccatgtgcacaggaaagtttaaagttgtgaaggaaatagcagaaacacaacatggaacaatagttgtcagagtacaatatgaaggggacggttctccatgtaagattccttttgagataatggatttggaaaaaagacatgtcttgggtcgcctgattacagtcaacccaattgtgacagaaaaggatagcccagtcaacatagaagcagaacctccattcggagacagctacgtcatcataggagtggagccggggcaattgaaactgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctacggggctgccttcagcggagtctcgtggaccatgaaaatcctcataggagtcattatcacatggataggaatgaattcacgtagcacctcactgtctgtatcactagtattggtgggggtcgtgacactgtacttgggagtcgtggtgcaggccgatagtggttgcgttgtgagctggaaaaacaaagaactgaaatgtggtagtgggattttcatcacagacaacgtgcacacatggacagaacaatacaagttccaaccagaatctccttcaaaactagcttcagctatccagaaagctcatcaagagggcatttgtggaatccgctcagtaacaagactggaaaatttgatgtggaaacaaataacaccggaattgaatcacattttatcagaaaatgaggtgaagctgactatcatgacaggagatatcaaaggaatcatgcatgcaggaaaacgatctctgcggcctcagcccactgagctgaggtattcatggaagacatggggcaaagcgaaaatcctctccacagagtcccataaccagacctttctcattgatggccccgaaacagcagaatgccccaacacaaacagagcttggaattcactggaagttgaagactatggctttggagtattcaccaccaatatatggctaaagctgagagaaaagcaggatgccttttgcgacccaaaactcatgtcagcggccataaaagacaacagagccgtccatgccgacatgggttattggatagaaagtgcacttaatgacacatggaagatagagaaagcctctttcattgaagttaaaaactgccactggccaaagtcacacaccctttggagcaatggagtgctagaaagtgagatgataattccaaaaaatttcgctggaccagtgtcacaacacaactacagaccaggctaccatacacaaacagcaggaccatggcatttaggtaagcttgagctggactttgatttctgcgagggaactacagtagtggtgactgaggactgtggaaatagagggccctccttaagaacaaccactgcctctggaaaactcataacagaatggtgctgcagatcttgcacattaccaccactaagatataaaggtgaggatggatgctggtacgggatggaaattagaccattgaaagaaaaagaagagaatttggtcagctccttggtcacagccggacatgggcagattgacaacttctcactaggagtcttgggaatggcattgtttctggaagaaatgctcaggacccgagtgggaatgaaacatgcaatactactagttgcagtttcttttgtgacattaatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagtaccataccagagaccattcttgaactgactgatgctttagccttgggcatgatggtcctcaaaatagtgaggaaaatggaaaggtatcaactggcagtgactatcatggccatcttgtgcgtcccaaattcagtgatattacaaaacgcatggaaagtgagctgcacaatactggcagtggtgtccgtttccccactgcttttaacatcctcacagcagaaagcggactggataccattagcattgacgattaaaggtctcaatccaacagctatatttctaacaaccctttcacgaaccagcaagaaaaggagttggccactaaatgaggctatcatggcagtcgggatggtgagcattttagccagttcacttctaaagaatgatattcccatgacaggaccactggtggctggagggctcctcacagtgtgctacgtgctcactggacgatcggccgacctggaattggagaaagctgctgacgtcagatgggaagatcaggcagagatatcaggaagcagtccaatcctgtcagtaatagtatcagaagatggtagcatgtcaataaaaaacgaagaggaagaacaaacactgaccatactcattagaacaggattgctggtgatctcaggactttttcctgtatcaataccaattacagcagcagcatggtacctgtgggaagtgaagaaacaacgggctggagtactgtgggatgtcccttcacccccacctgtgggaaaggctgaactggaagatggagcctatagaatcaagcagaaagggattctcggatattcccagatcggagccggagtttacaaagaaggaacattccatacaatgtggcatgtcacacgtggtgctgtcctaatgcataaaggaaagaggattgagccatcatgggcggacgtcaaaaaagacctaatatcatatggaggaggctggaaattggaaggagaatggaaggaaggagaagaagtccaggtcctggcattggagcctggaaaaaatccaagagccgtccaaacaaaacctggtcttttcaaaaccaatgctggaaccataggtgccgtatctctggacttttctcctggaacgtcaggatcaccaatcattgataaaaaaggaaaggtggtgggtctttatggtaatggcgttgttacaaggaatggatcatatgtgagtgctatagcccagacggaaaaaagcattgaagacaatccagagattgaagatgacatttttcgaaagaaaagattgaccatcatggacctccacccaggagcaggaaaaacgaaaagataccttccggccatagtcagagaagccataaaacggggcctgaggacactaattctggcccccactagagttgtggcagctgaaatggaggaagctcttagaggacttccaataagataccaaaccccagccatcagagccgagcacaccgggcgggagattgtggacctaatgtgtcatgccacattcactatgaggctgctatcgccaattagagtaccaaattacaacctgattatcatggatgaagcccatttcacagacccagcaagtatagcggccagaggatacatctcaactcgagtggaaatgggtgaggcagctgggattttcatgacagccactcctccagggagcagagacccttttccccagagcaatgcaccaatcatggatgaagaaagagaaatccctgaacgttcgtggaattccggacatgaatgggttacggattttaaagggaagactgtttggttcgttccaagtataaaagcgggaaatgacatagctgcttgcctgagaaaaaatggaaagaaagtgatacaactcagcaggaaaacctttgattctgagtatgtcaagactagaaccaatgactgggactttgtggttacgactgacatttcagaaatgggtgccaacttcaaggctgagagggtcatagatcccagacgctgcatgaaaccagttatactaacagatggtgaagagcgggtgatcctggcaggacccatgccagtgacccactctagtgcagcacaaagaagagggagaataggaagaaatccaaaaaatgaaaacgaccagtacatatacatgggggaacctctggaaaatgacgaagactgtgcacactggaaagaagccaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcttggaagaaaacgtggaagtggaaatctggacaaaagaaggggaaaggaagaaattaaaacccagatggttggacgccaggatctattctgaccccctagcgctaaaagaattcaaggaatttgcagctggaagaaagtccctgaccctgaaccttatcacagaaatgggaaggcttccaactttcatgactcagaaggcaagagacgcattggataacctggcagtgctgcacacggctgaagcaggtggaagggcgtacaatcatgctctcagcgaactgccggagaccctggagacactacttttactgacacttctggctacagtcacgggaggaatctttttattcttgatgagcggaagaggtatagggaagatgaccttaggaatgtgctgcataatcacggccagcatccttctatggtacgcacaaatacagccacactggatagcagcttcaataatattggaattttttctcatagttctgcttattccagaaccagaaaagcagagaacaccccaagataaccaattaacctacgttgtcatagccatcctcacagtggtggccgcaaccatggcaaacgagatgggtttcctggaaaaaacgaagaaagatctcggattaggaagcattgcaacccagcaacccgagagcaacatcctggacatagacctacgtcctgcatcagcatggacgctgtatgccgtggctacaacattcatcacaccaatgttgagacatagcattgaaaattcctcagtgaacgtgtccctaacagctattgccaaccaagccacagtgttaatgggccttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagggaagcccagaaaagagcagcagcgggcatcatgaaaaacccaactgttgacggaataacagcaatcgacttagatccaataccctatgacccaaagtttgaaaagcagttgggacaagtaatgctcctagtcctctgtgtgactcaagtattggtgatgaggactacatgggctctgtgtgaagctttaaccctagcgaccgggcccatttccacattgtgggaaggaaatccagggaggttttggaatactaccattgcagtgtcaatggccaacatttttagaggaagttacttggctggagctggacttctcttttccatcatgaagaacacaaccaacacaagaaggggaactggcaacataggagagacgcttggagagaaatggaaaagccggttgaacgcattggggaaaagtgaattccagatctacaagaaaagtggaatccaggaagtggatagaaccttagcaaaagaaggcattaaaagaggagaaacggaccaccacgctgtgtcgcgaggctcagcaaaactgagatggttcgtcgagagaaacatggtcacaccagaagggaaagtagtggaccttggttgcggcagaggaggctggtcatactattgtggaggacttaagaatgtaagagaagtcaaaggcctgacaaaaggaggaccagggcacgaagaacccatccctatgtctacatacgggtggaacctagtgcgtcttcaaagtggagttgacgttttcttcactccgccagaaaagtgcgacacattgctgtgtgacataggggagtcgtcaccaaatcccacggtagaagcgggacgtacactcagagtcctcaacttagtggaaaattggttgaacaacaacacccaattttgcataaaggttctcaacccatacatgccctcagtcatagaaaaaatggaagcactacaaaggaaatatggaggagctttagtgaggaatccactctcacgaaactccacacatgaaatgtactgggtatccaatgcctccgggaacatagtgtcatcagtgaacatgatttcaaggatgttgatcaacagattcacaatgaagcacaagaaagccacttacgagccagatgttgacttaggaagcggaacccgcaatatcggaattgaaagtgaggtaccaaacctggacataatcgggaaaagaatagaaaaaataaaacaagagcatgaaacatcatggcactatgaccaagaccacccatacaaaacatgggcttaccatggtagctatgaagcaaaacaaactggatcagcatcatccatggtgaacggagtggtcagactgctgacaaaaccttgggacgtcatccccatggtgacacagatggctatgacagacacgactccatttggacaacagcgcgtttttaaagagaaagtggacacgagaacccaagaaccgaaagaaggcacgaagaaattaatgaaaatcacggcagaatggctttggaaagaactagggaagaaaaagacacctaggatgtgtactagagaagaattcacaagaaaggtgagaagcaatgcagccttgggggccatattcactgatgagaacaagtggaagtcggcacgtgaggctgtcgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacggtttttagagtttgaagccctaggattcttgaatgaagatcactggttctccagagagaactccctgagtggagtggaaggagaagggctgtacaagctaggctacattttaagagacgtgagcaagaaagaaggaggagcaatgtatgccgatgacaccgcaggatgggacacaagaatcacactggaagatctaaaaaatgaagaaatggtaacaaaccacatggaaggagaacacaaaaaactagctgaggctattttcaaattaacgtaccaaaacaaggtggtgcgtgtgcaaagaccaacaccaagaggcacagtaatggatatcatatcgagaagagaccaaagaggtagcggacaagttggtacctatggactcaacactttcactaacatggaagcccaactaatcagacagatggaaggagaaggaatcttcaaaagcattcaacacttgacagccacagaagaaatcgccgtgcaaaactggctaacaagagtagggcgcgaaaggttatcaagaatggccatcagtggagatgattgtgttgtgaaacccttagatgacagattcgcaagtgccttaacagctctaaatgacatgggaaaggtcaggaaagacatacaacaatgggaaccttcaagagggtggaatgattggacacaggtgcccttctgttcacatcatttccatgagttaatcatgaaagacggtcgcgtacttgtagttccatgtagaaaccaggatgaattgattggtagagcccgaatttcccagggagctggatggtctttgcgggaaacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgtggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6369 - RNA, 9876 nt, synthetic construct
  misc_feature 1..9876: note = derived and/or modified CDS sequence (wt) from DENV-2__KF744402__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatctacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagctctgatcttcatcttattgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccaacattggattttgaactgataaaaacagaagccaaacatcctgccactttaaggaagtattgtatagaggcaaagctgaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgttcacatgcaaaaagaacatggaaggaaaaatcgtgcaaccagaaaacttggaatataccatcgtgataacacctcactcaggggaagagcacgcagttggaaatgacacaggaaaacacggcaaggaaattaaagtaacaccacagagttccatcacagaagcagaactgacaggctatggcacagtcacgatggagtgctctccgaggacgggcctcgatttcaatgagatggtgttgttgcaaatggaaaacaaagcttggctggtgcaccggcaatggttcctagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcaggaaacttactgttcacaggacatctcaagtgcagactgaggatggacaaactacagctcaaaggaatgtcatactccatgtgtacaggaaagtttaaagttgtgaaggaaatagcagaaacacaacatggaacaatagtcgtcagagtacaatatgaaggggacggttctccatgtaagattccctttgagataatggatttggaaaaaagacatgtcttgggccgcctgatcacagtcaacccaattgtgacagaaaaggatagcccagtcaacatagaagcagaacctccattcggagacagctacgtcatcataggagtggagccggggcaattgaagctgaattggtttaagaaaggaagttctatcggccaaatgtttgagacaacaatgaggggagcgaagagaatggctattctaggtgacacagcttgggattttggatctctgggaggagtattcacatctataggaaaggctctccaccaggtttttggagcaatctacggcgctgccttcagcggggtctcgtggactatgaaaatcctcataggagtcattatcacatggataggaatgaattcacgtagcacctcactgtctgtatcactaatattggtgggagtcgtaacactgtacctgggagtcgtggtgcaggccgatagtggttgcgttgtgagctggagaaacaaagaactgaaatgtggtagtgggattttcatcacagacaacgtgcacacgtggacagaacaatacaagttccaaccagaatctccctcaaaactagcttcagctatccagaaagctcatcaagagggcatttgtggaatccgctcagtaacaagactggaaaatttgatgtggaaacaaataacaccggaattgaatcacattctatcagaaaatgaggtgaagctgaccatcatgacaggagatatcaaaggaatcatgcatgcaggaaaacgatctttgcggcctcagcccactgagctgaggtattcgtggaaaacatggggcagagcgaaaatcctctctacagagtcccataaccagaccttcctcattgatggccccgaaacagcagaatgccccaacacaaacagagcttggaactcacttgaagttgaagactatggctttggagtattcaccaccaatatatggctgaagctgaaagaaaggcaggatgtattttgtgactcaaaactcatgtcagcagccataaaagacaacagggccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaattttgctggaccagtgtcacaacacaactacagaccaggctaccatacacaaacagcaggaccatggcatttaggtaagcttgagatggactttgatttctgcgagggaactacagtggtggtgactgaggactgtggaaatagaggaccctccttaagaacaaccactgcctctggaaaactcataacagaatggtgctgcagatcttgcacattaccaccgctaaggtacagaggtgaggatggatgctggtatggaatggaaatcagaccattgaaagagaaagaagagaacttggtcaactctttggtcacagccggacatgggcagattgacaacttctcattaggagtcttgggaatggcattgtttctggaagaaatgctcaggacccgagtaggaacgaaacatacaatactactagttgcagtttcttttgtgacattgatcacagggaacatgtcctttagagacctggggagagtgatggttatggtgggcgctactatgacggataacataggtatgggcgtgacttatcttgccctactagcagccttcaaagtcagaccaacttttgcagctggactactcttgagaaagttgacctctaaggaattgatgatgactaccataggaattgtactcctctctcagagcaccataccagagactatactcgaactgactgacgcgctggctttggggatgatggttctcaaaatagtgagaaacatggaaaagtatcaactagcagtgactatcatggccatcttgtgcgtcccaaatgcagtgatattacaaaacgcatggaaagtgagctgcacaatattggcagtggtgtccgtttccccactgttattaacatcctcacagcagaaagcggattggataccattagcattaacgattaaaggtctcaatccaacagctatatttctaacaaccctttcacgaaccagcaagaaaaggagctggccactaaatgaggctatcatggcagtcgggatggtgagcattttagccagttcactcttaaaaaatgacattcccattacaggaccattagtagctggagggcttctcactgtgtgttacgtgctcactggaagatcggctgatttggaactggagagagctgctgacgtaagatgggaagaacaggcagagatatcgggaagtagtccaatcctgtcaataataatatcagaggatggcagcatgtcaataaaaaacgaagaggaagaacaaacactgaccatactcattagaacaggattgctggtgatatcaggactttttcccgtatcaataccaattacggcagcagcatggtacttgtgggaagtgaagaaacaacgggctggagtattgtgggatgttccttcacccccacctgtgggaaaagctgaactggaagatggagcctacagaatcaagcaaaaagggattctcggatattcccagatcggagccggagtttacaaagaaggaacattccatacaatgtggcatgtcacacgtggtgctgttctaatgcataaaggaaagaggattgagccatcatgggcggacgtcaaaaaagacctaatatcatatggaggaggctggaaactagagggggaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacgggaaaaagcattgaagacaatccagagattgaagatgacatttttcgaaagaaaagactgaccatcatggacctccacccaggagcaggaaagacgaaaagataccttccagcaatagtcagagaagccataaaacgaggcttgaggacattaattctggcccccactagagttgtggcagctgaaatggaggaagctcttaggggactcccaataagataccaaacccccgccatcagagctgagcacactgggcgggagattgtggatctaatgtgtcacgccacatttaccatgaggctgctatccccaattagagtaccaaattacaacctgattatcatggatgaagcccatttcacagacccagcaagtatagcggccagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagatggtgaagagcgggtgatcctagcaggacccatgccagtgacccactctagtgcagcacaaagaagagggagaataggaagaaatccaaaaaatgaaaacgaccagtacatatacatgggggaacctctggaaaacgacgaagaccacgcacactggaaagaagctaaaatgctcctagataacatcaatacacctgaaggaatcattcctagtatgttcgaaccagagcgcgaaaaggtggatgccattgatggtgaataccgcttgagaggagaagcgaggaaaacttttgtagacctaatgagaagaggagacctaccagtctggttggcctacaaggtggcagctgaaggtatcaactacgcagacagaaggtggtgttttgatggaatcaggaacaaccaaatcctggaagaaaatgtggaagtggaaatctggacaaaagaaggagaaaggaagaaattaaaacccagatggctggacgctaggatctattctgacccattagcgctaaaagaattcaaggaattcgcagctggaagaaagtccctgaccctgaacctaatcacagaaatgggaaggcttccaactttcatgactcagaaggcaagagacgcattggacaacctggcagtgctgcacacggctgaagcaggtggaagggcgtacaatcatgctcttagtgaactgccggagaccctggagacattgcttttactgacactcttggccacagtcacgggcggaatcttcctattcttgatgagcggaaaaggcatagggaagatgaccctgggaatgtgctgcataatcacggccagtgttctcctatggtacgcacaaatacagccacactggatagcagcttcaataatactggaatttttcctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagacttcggattgggaagcattgcaacccagcaacccgagagcaacatcctggacatagatctacgtcctgcatcagcatggacgctgtatgccgtggccacaacattcatcacaccaatgttgagacatagcattgaaaattcctcagtgaacgtgtccctaacagctattgccaaccaagccacagtgttaatgggtcttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacttagatccaataccctatgatccaaagtttgaaaaacagttgggacaagtaatgctcctagtcctctgtgtgactcaagtattgatgatgaggactacatgggctctgtgtgaagctttaaccttagcgacagggcccatttccacattgtgggaaggaaatccagggaggttttggaatacaactattgcagtatcaatggctaacatttttagagggagctacctggccggagccggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatggtcacaccagaagggaaagtagtggaccttggttgtggcagaggaggctggtcatactattgtgggggactaaagaatgtgagagaagtcaaaggcctaacaaagggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacataagaaggccacatacgagccagatgttgacctcggaagcggaacccgtaacatcggaattgaaagtgaggtaccaaacctggacataattgggaaaagaatagaaaaaataaaacaagagcatgaaacatcatggcactatgaccaagatcacccatacaaaacatgggcttatcatggtagctatgaaacaaaacaaactggatcagcatcatccatggtgaacggagtggtcagactgctgacaaaaccttgggacgtcatccccatggtgacacagatggctatgacagacacgactccatttggacaacagcgcgtctttaaagagaaagtggacacgagaacccaagaaccgaaagaaggcacaaagaaattaatgaaaattacggcagaatggctttggaaagaactagggaagaaaaagacacctaggatgtgtactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggctcggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcgagaagagaccaaagaggtagcggacaagttggtacctacggcctcaacactttcactaacatggaagcccaactaatcagacagatggaaggagaaggagtcttcaaaagcattcagcacctgacggccacagaagaaatcgccgtgcaaaactggctagcaagagtagggcgcgaaaggttatcaagaatggccatcagtggagatgactgtgttgtgaaacccttagatgacagattcgcaagtgctctaacagctttaaatgacatgggaaaggtcaggaaagacatacaacaatgggaaccttcaagagggtggaatgattggacacaggtgcccttctgttcacatcatttccatgagttaatcatgaaagacggtcgcgtacttgtagttccatgtagaaaccaagatgaattgattggtagagcccgaatttcccagggagccgggtggtctttgcgggaaacagcctgtttggggaagtcttacgcccaaatgtggagcctgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6370 - RNA, 9876 nt, synthetic construct
  misc_feature 1..9876: note = derived and/or modified CDS sequence (wt) from DENV-2__KF744408__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgttcaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccgacattggattttgaactgataaaaacggaagccaaacatcccgccactttaaggaagtattgtatagaggcaaagctgaccaacacaacaacagcatctcgctgcccaacacaaggggaacccagcctaaatgaagagcaggataaaaggttcgtctgcaaacactccatggtagacagaggatggggaaatggatgtggactatttggaaaaggaggcattgtgacctgtgcaatgtttacatgcaaaaagaacatggaaggaaaaatcgtgcaaccagaaaacttggaatataccatcgtgataacacctcactcaggggaagagcacgcagttggaaatgacacagggaaacatggcaaggaaatcaaaataacaccacagagttccatcacagaagcagaactgacaggctatggcactgtcacgatggaatgctctccgagaacgggcctcggctttaatgagatggtgttgctgcaaatggaagacaaggcttggctggtgcaccggcaatggttcctagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgtaggctgaggatggacaaactacagctcaaaggaatgtcatactccatgtgcacaggaaagtttaaagttgtgaaggaaatagcagaaacacaacatggaacaatagtcgtcagagtacaatatgaaggggacggttctccatgtaagattccttttgagataatggatttggaaaaaagacatgtcttaggtcgcctgatcacagtcaacccaattgtgacagaaaaggatagcccagtcaacatagaagcagaacctccattcggagacagctacgtcatcataggagtagagccggggcaactgaagctcagctggtttaagaaaggaagttctatcggccaaatgtttgagacaacaatgaggggagcgaagagaatggctattctaggtgacacagcttgggattttggatccctgggaggagtattcacatctataggaaaggccctccaccaggtctttggagcaatctatggggctgcctttagcggggtttcatggactatgaaaatcctcataggagtcattatcacatggataggaatgaattcacgtagcacctcactgtctgtatcactagtattggtgggagtcgtgacactgtatctgggagttgtggtgcaggccgatagtggttgcgttgtgagctggagaaacaaagaactgaaatgtggtagtgggattttcatcacagacaacgtgcacacgtggacagaacaatacaagttccaaccagaatccccctcaaaactagcttcagctatccagaaagctcatcaagagggcatttgtggaatccgctcagtaacgagactggaaaatttgatgtggaaacaaataacaccggaattgaatcacattctatcagaaaatgaggtgaagttgactatcatgacaggagatatcaaaggaatcatgcaggcaggaaaacgatctttgcggcctcagcccactgagctgaggtattcatggaaaacatggggcaaagcgaaaatcctctctacagagtcccataaccagaccttcctcattgatggccccgaaacagcagaatgccccaacacaaacagagcttggaactcacttgaagttgaagactatggctttggagtattcaccaccaatatatggctaaggctgagagaaaagcaggatgcattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctaccatacacaaacggcaggaccctggcatctaggtaagcttgagatggattttgatttctgcaagggaactacagtggtagtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcaggccattgaaagagaaagaagagaacctggtcaactctttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagcaccataccagagactatactcgaactgactgacgcgctggctttggggatgatggttctcaaaatagtgagaaacatggaaaagtatcaactggcagtgactattatggctatcttgtgcgtcccaaatgcagtgatattacaaaacgcatggaaagtgagctgcacaatattggcagtggtgtccgtttccccactgctattaacatcctcacagcagaaagcggattggataccattagcattaacgattaaaggtctcaatccaacagctatatttctaacaaccctttcacgaaccagcaagaaaaggagctggccactaaatgaggctatcatggcagtcgggatggtgagcattttagccagttcacttctaaaaaatgacattcccatgacaggaccattggtggctggagggctcctcacagtatgctatgtgctcactggacgatcggccgatttggaattggagaaagctgctgacgtcagatgggaagatcaggcagagatatcaggaagtagtccaatcctatcaataataatatcagaagatggcagcatgtcaataaaaaacgaagaggaagaacaaacactgaccatactcattagaacaggactgctggtgatctcaggactttttcctgtatcaataccaatcacggcagcagcatggtacctgtgggaagtgaagaaacaacgggctggagtattgtgggatgtcccttcacccccacctgtgggaaaagctgaactggaagatggagcctacagaatcaagcaaaaagggattctcggatattcccagatcggagccggagtttacaaagaaggaacattccatacaatgtggcacgtcacacgtggtgctgttctaatgcataaaggaaagaggattgagccatcatgggcggacgtcaaaaaagacctaatatcatatggaggaggctggaaactagaaggagaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacggaaaaaagcattgaagacaatccagagattgaagatgacatttttcgaaagaaaagattgaccatcatggacctccacccaggagcaggaaagacgaaaagataccttccggccatagtcagagaagccataaaacgaggcttgaggacactaatcctggcccccactagagttgtggcagctgaaatggaggaagctcttaggggactcccaataagataccaaacccccgccatcagagccgagcacaccgggcgggagattgtggacctaatgtgtcatgccacatttaccatgaggctgctatcgccaattagagtaccaaattacaacttgattatcatggatgaagcccatttcacagacccagcaagtatagcagctagaggatacatttcaactcgagttgagatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccattctagtgcagcacaaagaagagggagaataggaagaaatccaaaaaatgaaaacgaccagtacatatatatgggggaacctctggaaaacgacgaagactgtgcacactggaaagaagctaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggagaaaggaagaaattaaaacccagatggctggacgctaggatctattctgacccattagcgctaaaagaattcaaggaatttgcagctggaagaaagtccctgaccctgaacctaatcacagaaatgggaaggcttccaactttcatgactcagaaagcaaggaacgcactagacaacttagcagtcctgcatacggctgaagcaggcggaagggcgtacaatcatgctcttagtgaactgccggagaccctggagacattgcttttactgacactcttggccacagtcacgggcggaatcttcctattcttgatgagcggaaaaggcatagggaagatgaccttaggaatgtgctgcataatcacggccagtgttctcctatggtacgcacaaatacagccacactggatagcagcttcaataatactggaatttttcctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattaggaagcattacaacccagcaacccgagagcaacatcctggacatagatctacgtcctgcatcagcatggacgctgtatgccgtggccacaacattcatcacaccaatgttgagacatagcattgaaaattcctcagtgaacgtgtccctaacagctattgccaaccaagccacagtgttaatgggtcttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacctagatccaataccctatgatccaaagtttgaaaagcagttgggacaagtaatgctcctagtcctctgtgtgactcaagtattgatgatgaggactacatgggctctgtgtgaagctttaaccttagcgacagggcccatttccacattgtgggaaggaaatccagggaggttttggaacactaccattgcagtgtcaatggctaacatttttagagggagctacctggccggagccggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatgatcacaccagaagggaaagtagtggaccttggttgcggcagaggaggctggtcatactattgtgggggactaaagaatgtaagagaagtcaaaggcctgacaaagggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtgaacggagtggtcagactgctgacaaaaccttgggacgtcatccccatggtgacacagatggctatgacagacacgactccatttggacaacagcgtgtttttaaagagaaagtggacacgagaacccaagaaccgaaagaaggcacaaagaaattaatgaaaatcacggcagaatggctttggaaagaactagggaagaaaaagacacctaggatgtgtactagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcggacaagttggtacctacggactcaacactttcactaatatggaagcccaactaatcagacagatggaaggagaaggagtctttaaaagcattcagcacctgacggccacagaagaaattgccgtgcaaaactggctagcaagagtagggcgcgaaaggttatcaagaatggccatcagtggagatgactgtgtagtgaaacccttagatgacagattcgcaagtgctttaacagctctaaatgacatgggaaaagtcaggaaagacatacaacaatgggaaccttcaaaagggtggaacgattggacacaggtgcccttttgttcacaccatttccatgagttaatcatgaaagacggtcgcgtacttgtagttccatgcagaaaccaagatgaattgattggtagggcccgaatttcccagggagctggatggtctttgcgggaaacagcctgtttggggaagtcttacgcccaaatgtggagcctgatgtacttccacagacgtgaccttaggctggcggcaaatgccatttgctcggcagtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6371 - RNA, 9876 nt, synthetic construct
  misc_feature 1..9876: note = derived and/or modified CDS sequence (wt) from DENV-2__JX669476__SS-prME
  source 1..9876: mol_type = other RNA
acagcaggcgtgattgttatgttgattccaacagcaatggcgttccatttaaccacacgtaatggagaaccacacatgatcgttggtaggcaagagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactcaacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagtcagaaaatttggaatacaccatcgtgataacacctcactcaggagaagagcacgctgtaggtaatgacacaggaaagcacggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgaggatggacaaactacagctcaaaggaatgtcatactctatgtgtacagggaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatctctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaattcccttcaaaactagcttcagctattcaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaaagatccttgcggcctcagcccactgagctgaagtactcatggaaaacatggggaaaggcgaaaatgctctctacagagtctcacaaccagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaaggtggagaaagcctccttcattgaagttaaaagctgccactggccaaagtcacacaccctctggagcaatggagtattagaaagtgagatgataattccaaaaaattttgccgggccagtgtcacaacataactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacccttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgataactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaaacggattggataccattggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtggaaaaggccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatttaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggattttcatgacagccactcctccggggagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggtcatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtggtggccgcaaccatggcaaacgaaatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagccacagtgctaatgggtcttgggaaaggatggccattgtcaaagatggacattggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaattgagatggttcgtcgagagaaacatggtcacaccggaagggaaggtggtggatcttggttgcggcagagggggctggtcatactattgcgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaacctagacataataggaaagagaatagagaaaataaaacaagagcatgaaatatcatggcattatgaccaagaccacccatacaaaacgtgggcttaccatggcagctatgaaacaaaacaaactgggtcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatgataggttttgggagctagttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagactggcggcaaatgccatttgctcggcagtcccgtcacattgggttccaacaagtcgaacaacctggtccatacacgccaagcatgaatggatgacgacggaagacatgctgacagtctggaacagggtgtggatccaagaaaacccatggatggaagacaaaactccagtggaatcatgggaagaagtcccatacctgggaaaaagggaagaccaatggtgcggctcattgattgggctaacaagcagggctacctgggcaaagaatatccagacagcaataaatcaagtcagatcccttataggcaatgaaggatacacagactacatgccatccatgaagagattcagaagagaagaggaagaggcaggtgtcctgtggtag

SEQ ID NO: 6372 - RNA, 9876 nt, synthetic construct
  misc_feature 1..9876: note = derived and/or modified CDS sequence (wt) from DENV-2__JX475906__SS-prME
  source 1..9876: mol_type = other RNA
actgtaggcatgatcatcatgctgattccaacagcgatggcgttccatttaaccacacgcaatggagaaccacacatgatcgtcagcagacaagagaaagggaaaagtctcttgtttaaaacagaggatggtgtgaacatgtgtaccctcatggccatggaccttggtgaactgtgtgaagacacagtcacttataactgtcctcttctcaggcagaatgaaccagaagacatagactgctggtgcaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacaacatatttccaaagagtcctgattttcatcttactgacagctgtcgctccttcaatgacaatgcgctgtataggaatatcaaacagagactttgtggaaggggtttcaggaggaagctgggttgacatagtcttagaacatggaagctgtgtgacaacgatggcaaaaaacaaaccaacattggactttgagctgataaaaacagaagccaagcaacctgccactctaaggaagtactgtatagaggcaaagctgaccaacacaacaacagcatctcgatgcccaacacaaggggaacccagcctaaacgaagagcaggacaaaaggtttgtctgcaaacattccatggtagacagaggatggggaaatggatgtggattatttggaaaaggaggcatcgtgacctgtgccatgttcacatgcaaaaaaaacatggaagggaaaatcgtgcaaccagaaaacctggaatacaccattgtgataacacctcactcaggggaagagaatgcagttggaaatgacacaggaaaacatggcaaggaagtcaaagtaacaccacagagttccattacagaagcagaactgacaggctatggcaccgtcacgatggagtgctctccgagaacgggccttgacttcaatgagatggtgttgctgcaaatggaaaacaaagcttggttggtgcacaggcaatggttcttagacctgccgttaccatggctgcccggagcggacacacaaggatcaaattggatacagaaggagacattggtcaccttcaaaaatccccatgcgaagaaacaggatgttgttgttttaggatctcaagaaggggctatgcatacagcacttacaggggccacggaaatccagatgtcatcaggaaacctactgttcacaggacatctcaagtgcaggctgagaatggacaaactacagctcaaaggaatgtcatactctatgtgtacaggaaagtttaaagttgtaaaggaaatagcagaaacacaacatggaacaatagttatcagagtacaatatgaaggggatggttctccatgtaaaatcccttttgagataatggacctggaaaaaagacatgtcttaggtcgcctgattacagtcaacccaattgtcacagaaaaagacagcccagtcaacatagaagcagaacctccattcggagacagctacatcattataggagtagaaccgggacaactgaagctcagctggtttaagaaaggaagctcaatcggccaaatgttcgagacaacaatgagaggagcgaagagaatggctattttaggtgacacagcctgggattttggatccctgggaggagtgttcacatctataggaaaggccctccaccaagtttttggagcaatctatggggctgccttcagtggggtctcatggaccatgaaaatcctcataggagttgtcatcacatggataggaatgaattcacgcagcacctcactgtccgtgtcgttagtattagtgggagtcgtgacattgtatttgggagtcatggtgcaggctgatagtggttgtgttgtgagttggaaaaacaaagaactgaaatgtggcagcgggatctttatcacagacaatgtacacacatggacagaacaatacaaattccaaccagaatccccctcaaagctggcttcagccatccaaaaagctcatgaagagggcatttgtggaatccgctcagtaacaagactggagaatctaatgtggaaacaaataacaccagaactgaaccacattctatcagaaaatgaggtaaagttgactatcatgacaggagacatcaaaggaatcatgcaggcaggaaagcggtccctgcggcctcagcccactgagctgaagtattcatggaaaacatggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcggcagccataaaagacaacagagccgtccatgccgatatgggttattggatagaaagcgcgcttaatgacacatggaagatagaaaaagcctccttcatcgaagttaaaagctgccactggccaaaatcacacactctctggagcaatggagtgctagaaagtgagatgataattccaaagaattttgctggaccagtatcacaacacaattacagaccaggctatcacacacaaacggcaggaccctggcatctaggcaagcttgagatggactttgatttttgtgaaggaaccacagtggtggtgactgaggactgtggaaatagaggaccctctctaagaacaactaccgcttctggaaaactcataacagaatggtgttgccgatcctgcacattaccaccgctaagatacagaggtgaggatggatgctggtacggaatggaaatcagaccattgaaagagaaagaagagaacctggtcaactctttggtcacagccggacacggacagattgacaacttctcgctaggagtcttgggaatggcattgttcctggaagaaatgctcaggacccgagtaggaacaaaacatgcattattactagttgcagtttctttcatgacattgatcacagggaatatgtctttccgagacctggggagagtgatggttatggtgggggctgctatgacggacgacataggtatgggcgtgacttatcttgccttattagcagccttcaaagttagaccaacttttgcagctggactacttttaagaaagctgacctccaaggaattgatgatgaccaccataggaattgtacttctctcccagagcaccataccagagactatacttgaactgactgatgcgttggccttgggcatgatgattctcaaaatagtgagaaatatggagaagtatcaattagcagtgaccatcatggctattttatgtgttccaaatgcagtgatactacaaaatgcatggaaagtgagctgcacaatactggcagtggtgtccgtttccccactgctcttaacatcctcacggcagaaagcggactggataccattggcattgacgatcaagggtctcaatccaacagccattttcctaacaaccctttcaagaaccaacaagaaaaggagttggccactaaatgaggctatcatggcagtcgggatggtgagcattttagccagttctctcctaaagaatgacattcccatgacaggaccactagtggctggagggcttctcactgtgtgttacgtgctcactggaagatcggctgatttggaactggagagagctgccgacgtaagatgggaagatcaggcagagatatcgggaagtagtccaattctgtcaataacaatatcggaagatggcagcatgtcaataaaaaatgaagaggaagaacaaacactgaccatactcattagaacaggattgctggtgatatcaggactttttcccgtatcaataccaatcacggcagcagcatggtacctgtgggaagtgaagaaacaacgggccggagtgttgtgggatgttccttcacccccacccgtgggaaaggccgaattggaagatggagcctatagaatcaagcagaaagggattcttggatactcccagatcggagctggagtctacaaagaaggaacattccacacaatgtggcacgtcacacgtggtgctgttctaatgcataaagggaagaggattgaaccatcatgggcggatgtcaggaaagacctaatatcgtatggaggaggctggaagctagaaggagaatggaaggaaggagaagaagtccaggttttggcattggagcctggaaagaatccaagagccgtccaaacaaaacccggtctttttaagactaacaccggaaccataggcgctgtatctctagacttttctcctggaacgtcaggatctccaatcgtcgacaaaaaaggaaaagtcgtgggtctttatggtaatggtgttgtcactagaagtggaacatatgtgagcgccatagcccaggctgaaaaaagcattgaagacaatccagagattgaagatgacatctttcggaaaagaagattgaccattatggacctccacccaggagcgggaaagacgaaaagataccttccagcaatagtcagagaggccataaaacgaggcttgagaacattaatcctggcccctactagagtcgtggcagctgaaatggaggaagctcttagaggacttccaataagataccaaaccccagccatcagagctgagcacactgggcgagaaatcgtggatttaatgtgtcatgccacatttaccatgaggctgctgtcaccagttagagtgccaaattacaacctgatcattatggatgaagcccatttcacagacccagcgagcatagcagctagaggatacatttcaactcgagtagagatgggtgaagcagctgggatttttatgacagccactcctccgggaagcagagacccatttcctcagagcaatgcaccaatcatggatgaggaaagggaaatccctgaacgttcgtggaattctggacatgaatgggttacggattttaaagggaagactgtttggtttgttccgagtataaaagcaggaaatgatatagcagcttgcctgaggaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacagacggtgaagagcgggtgatcttggcaggacccatgccagtgacccactctagtgcagcacaaagaagagggagaataggaaggaatccaaaaaatgaaaatgaccagtacatatacatgggggaacctctggaaaatgatgaagactgtgcacactggaaagaagctaagatgcttctagacaacatcaacacgcctgaaggaatcattcccagcatgtttgaaccagagcgtgaaaaggtggatgccattgatggtgagtaccgcttaagaggagaagcgaggaaaacctttgtggacctaatgagaagaggagacctaccagtctggctggcctacagagtggcagccgaaggcattaactatgcagacagaaggtggtgttttgatggagtcaagaacaaccaaatcttggaagaaaatgtggaagtggaaatctggacaaaagaaggagaaaggaagaaattgaaacccaggtggttggatgctaggatctattctgacccgctggcgctcaaagaattcaaagagtttgcagccggaagaaaatccctgaccctgaatctaatcacagaaatgggtaggcttccaacttttatgacccagaaagcaaggaatgcactggataacttagcagtcctgcacacagctgaagcaggcggaagagcgtacaatcatgctctcagtgaactgccggagaccctggagacattgcttttgctgacgcttttggctacagtcacgggcggaatctttttatttttgatgagcggaaaaggtatagggaaaatgactctgggaatgtgctgcataatcacggccagtattctcctatggtacgcacagatacagccacactggatagcagcttcaataatactggagttttttctcatagttttgcttattccagaaccagaaaagcagagaacaccccaagacaaccaattaacttacgttgtcatagccatcctcacagtggtggccgcaaccatggcaaacgagatggggtttctggaaaaaacgaagaaagatttcggattgggaagcattgcaacccagcagcccgagagcaacatcctggacatagatctacgccctgcatcagcatggaccctgtatgccgtggccacaacatttatcacaccaatgctgagacatagtattgaaaattcctcagtgaatgtgtctctaacagccattgccaaccaagccacagtgctaatgggtcttgggaaaggatggccattgtcaaaaatggacattggagttcctcttctcgccattgggtgctattcacaagtcaaccccataactctcacagcagcccttcttttattggtagcacattatgccatcatagggccaggactccaagcgaaagcaaccagagaagcgcagaaaagagcagcagcaggcatcatgaaaaacccaactgtggatggaataacagtgattgacctagacccaataccctatgatccaaaatttgagaaacagctgggacaagtgatgctcctagtcctctgcgtgactcaagtactgatgatgaggactacatgggctttgtgtgaggctctaaccttagcgaccgggcccatttccacattgtgggaaggaaatccagggagattttggaatacaactattgcagtgtcaatggctaacatttttagaggaagttacttggctggagctggacttctcttttccatcatgaagaacacaaccaacacaagaaggggaactggcaacacaggagagacgcttggagagaaatggaaaaaccgattgaatgcattagggaagagtgaattccagatttacaagaaaagcggaattcaggaagtggatagaaccttggcaaaagagggcatcaaaagaggagaaacagaccatcacgctgtgtcgcgaggctcagcaaagctgagatggttcgtcgagagaaacctggtcacaccagaagggaaagtagtggacctcggttgcggcagagggggctggtcatactattgtgggggcctaaagaatgtaagagaagtcaaaggcctaacaaaaggagggccaggacatgaagaacctattcccatgtcaacatatgggtggaatctagtgcgtcttcaaagtggagttgatgttttctttactccgccagaaaagtgtgatacattgttgtgtgacataggggagtcgtcaccaaatcccacggttgaagcaggacgaacactcagagtcctaaacttggtggaaaattggctgaacaacaacacccaattttgcataaaggttctcaacccatacatgccctcagtcatagagaaaatggaagcgctgcaaaggaaatacggaggagctttggtgaggaatccactctcaagaaattccacacatgagatgtattgggtatccaatgcttccgggaacatagtgtcatcagtgaacatgatttcaaggatgttgattaacagattcacaatgagacataagaaggccacatacgagccagatgttgacctcggaagcggaacccgcaacatcggaattgaaagtgagacaccaaacctagacataattggaaaaagaatagaaaaaataaaacaagagcatgaaacatcatggcactatgatcaagaccacccatataaaacgtgggcctaccatggcagctacgaaacaaaacagactggatcagcatcatccatggtgaatggagtggttagactgctgacaaaaccttgggacgtcatccccatggtgacacagatggcaatgacagacacgaccccatttggacaacagcgtgtttttaaagagaaagtggacacgagaacccaagaaccaaaagaaggcacgaagaaactaatgaaaatcacggccgaatggctctggaaggaattaggaaagaaaaagacacctaggatgtgcactagagaagaattcacaagaaaggtgagaagcaatgcagccctaggtgccatattcactgatgagaacaagtggaagtctgcacgtgaggctgttgaagacagtagattttgggaactggttgacaaggaaaggaatctccatcttgaaggaaagtgtgaaacatgtgtgtacaatatgatgggaaagagagagaagaaactaggggaattcggcaaagcaaaaggcagtagagccatatggtacatgtggcttggagcacgcttcttggagtttgaagccctaggattcttgaatgaagatcactggttttctagagagaactctttgagtggagtggaaggagaagggctgcacaagctgggttacattctaagagatgtgagcaagaaagaaggaggagcaatgtacgccgatgacactgcaggatgggacacaagaatcacactagaggacttaaaaaatgaagaaatggtgacaaaccacatggaaggagaacacaagaaacttgctgaggccatcttcaaattaacgtaccaaaacaaggtggtgcgtgtgcaaagaccgacaccaagaggcacagtaatggatattatatcgagaagagaccaaagaggaagtggacaagttggcacctatggcctcaacactttcaccaatatgggagcccaattaatcagacagatggagggagaaggagtctttaaaagcatccagcacctgacagctacagaagaaattgcagtgcaagactggttagcaagagtggggcgtgagaggttatcaagaatggctatcagtggagatgattgtgttgtgaaacccttagatgacaggtttgcaagcgctttaacggctctaaatgacatgggaaaggttaggaaagacatacaacaatgggaaccttcaagaggatggaacgattggacacaggtgcctttctgttcacaccatttccatgagctaatcatgaaagatggtcgtgtactcgttgttccatgtagaaaccaagatgaactgattggcagagcccgaatttcccagggagccgggtggtctttgcgggagacggcctgtctgggaaagtcttacgcccaaatgtggagcctgatgtactttcacagacgtgacctcaggctggcggcaaacgctatttgctcggcagtcccatcacactgggttccaacaagtcgaacaacctggtccatacacgccaaacatgaatggatgacaacagaagacatgctgacagtctggaacagggtgtggattcaagaaaacccatggatggaagacaaaactccagtggaatcatgggaggaaatcccatacttgggaaaaagagaagaccaatggtgcggctcattgatagggctaacaagcagggctacctgggcaaagaacatccaaacagcaataaaccaagtcagatccttaataggcaatgaggaatacacagactatatgccatccatgaaaagattcagaagagaagaggaagaggcaggggtcttgtggtag

SEQ ID NO: 6373 - RNA, 9876 nt, synthetic construct
  misc_feature 1..9876: note = derived and/or modified CDS sequence (wt) from DENV-2__JX669477__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgcttgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggactatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttccaccacagaagcagaactgacaggctatggcactgtcacgatggagtgctctccgagaacgggccttgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagtttttggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaattcgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgacatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatacagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgaacgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgcttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgcacactcatgctctcagtgaactgccggagactctggagacactgcttctactgacactcctggcagcagtcacaggaggaatcttcttattcttaatgagcggaaaaggcatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaatgagatgggtttcctggaaaaaaccaagaaagacctcggatttggaagcattacaacccaggaatctgagagcaacatcctggacatagatctacgtcctgcatcagcatggacgttgtatgccgtggccacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcgcattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgccgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcactccgccagaaaagtgtgatacattgttgtgtgacataggggagtcgtcaccaaatcccacgatagaagcaggacgaacactcagagtcctcaatttagtggaaaattggctgaacaataacacccaattttgcataaaggtcctcaatccatatatgccctcagtcatagaaaaaatggaaacactacaaagaaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacgaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaatcacggcagagtggctttggaaagaactaggaaaagaaaagacacctagaatgtgtaccagagaagaattcacaagaaaagtgagaagcaatgcagccttgggggccgtattcactgatgaaaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagagaactccctgagtggagtggaaggagaagggctgcacaggctaggctacattttaagagatgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcagaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggccacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6374 - RNA, 9876 nt, synthetic construct
  misc_feature 1..9876: note = derived and/or modified CDS sequence (wt) from DENV-2__JX669478__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccctgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaacttaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagtcagaccaacttttgcagctggactactcttgagaaaactgacctccaaggaattgatgatggccaccataggaatcgcactcctttcccaaagcaccctgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaacaactctttcgagaaccagcaagaaaaggagctggccgctaaatgaagctatcatggcagtcgggatggtaagcattttagccagttctctcctaaaaaatgatattcctatgacaggtccattagtggctggagggctactcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaagatggagcctatagaatcaagcaaagagggatttttggatattctcagattggagccggagtttacaaagaaggaacattccatacaatgtggcacgtcacacgtggcgctgttctgatgcatagagggaagaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacatcaggatctccaattgtcgacagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttagaaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgtgtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgctgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattgggtgctactcacaagtcaaccctataaccctcacagcagctcttcttttattggtagcacattatgccattatagggccaggacttcaagcaaaagcaaccagagaagctcagaaaagagcagcagcaggcatcatgaaaaatccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaaccccacgatagaagcaggacgaacactcagagtcctcaacttagtggaaaattggctgaacaacaacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcatccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaggaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagctgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacatagactacatgccatccatgaagagattcagaagggaagaggaagaggcaggtgtcctgtggtag

SEQ ID NO: 6375 - RNA, 9876 nt, synthetic construct
  misc_feature 1..9876: note = derived and/or modified CDS sequence (wt) from DENV-2__JX669480__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtgacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagcggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagctgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttctcattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgtttctggaagagatgctcaggacccgagtaggaacgaaacatgcaatactgctagtcgcagtatcttttgtgacattgattactgggaacatgtcctttagagacctgggaagagtgatggttatggtgggcgttaccatgacggatgatataggtatgggagtgacttaccttgccctactagcagctttcaaagttagaccaactttcgcagctggactactcttgagaaaactgacctccaaggaattaatgatggccaccataggaatcacactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcctaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcaccggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtgggaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaagggatcattcctagtatgttcgaaccagagcgtgaaaaggtggatgccattgatggtgaataccgtttgagaggagaagcaaggaaaacctttgtggacctaatgagaagaggggacttaccagtctggttggcttacagagtggcagctgagggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaagacaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattataccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgcgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtaacaccagaagggaaggtggtggacctcggttgcggcagagggggctggtcatactattgtgggggactaaagaatgtaagagaagtcaaaggcctgacaaaaggaggaccaggacacgaggaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaataacaacacccaattttgcataaaggttctcaacccatatatgccctcagtcatagaaaaaatggaaacactacaaaggaaatatggaggagctttagtgaggaacccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagaatttgaagccctaggattcttgaatgaagatcactggttctccagagggaactccctgagtggagtggaaggagaagggctgcacaggctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatatttggggaaaagagaagaccaatggtgcggctcattgattgggctaacaagcagggctacttgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6376 - RNA, 9876 nt, synthetic construct
  misc_feature 1..9876: note = derived and/or modified CDS sequence (wt) from DENV-2__JX669483__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatcccgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcaaagtacaatatgaaggggacggctctccatgtaagatcccttttgagataatggatttggaaaaaagacacgtcttaggtcgcctgattacagttaacccaatcgtgacagaaaaagatagcccagtcaacatagaagcagaacctccattcggagacagctacatcatcataggagtagagccgggacaactgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagcggggtctcatggactatgaaaatcctcataggagtcatcatcacatggataggaatgaattcacgtagcacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagctgaccattatgacaggagacattaaaggaatcatgcaggcaggaaaacgatctttgcggccccagcccactgagctgaagtactcatggaaaacatggggaaaggcgaaaatgctctccacagagtctcacaatcagacctttctcattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgcggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatggtaggcgttaccatgacggatgatataggtatgggagtgacttaccttgccctactagcagctttcaaagttagaccaactttcgcagctggactactcttgagaaaactgacctccaaggaattaatgatggccaccataggaatcacactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagcggtgtccgtttctccattgctcctaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcaccggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtgggaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgttacaaggagtggagcatatgtgagtgctatagcccagaccgaaaaaagcattgaagacaatccagagatcgaagatgacatcttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaagggatcattcctagtatgttcgaaccagagcgtgaaaaggtggatgccattgatggtgaataccgtttgagaggagaagcaaggaaaacctttgtggacctaatgagaagaggggacttaccagtctggttggcttacagagtggcagctgaaggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaagacaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcctcaataatactggagtttttcctcatagttttgctcattccagaaccagaaaaacagagaacacctcaagacaatcaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattataccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgcgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggtttgtcgagagaaatatggtaacaccagaagggaaggtggtggacctcggttgcggcagagggggctggtcatactattgtgggggactgaagaatgtaagagaagtcaaaggcctgacaaaaggaggaccaggacacgaggaacccatccccatgtcaacatatgggtggaatctagtgcgtctgcaaagtggagttgacgtcttcttcaccccaccagaaaagtgtgatacattgttgtgtgacataggggagtcgtcaccaaatcccacgatagaagcaggacggacactcagagtcctcaacttagtggaaaattggttgaataacaacacccaattttgcataaaggttctcaacccatatatgccctcagtcatagaaaaaatggaaacactacaaaggaaatatggaggagctttagtgaggaacccactctcacgaaactccacacatgagatgtactgggtatccaatgctaccgggaacatagtgtcatcagtgaacatgatttcaaggatgttgattaacagattcacaatgaaacacaagaaagccacctatgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctatttagaatttgaagccctaggattcttgaatgaagatcactggttctccagagggaactccctgagtggagtggaaggagaagggctgcacaggctaggctacattttaagagacgtgagcaagaaggaagggggagcaatgtacgccgatgacacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatatctggggaaaagagaagaccaatggtgcggctcattgattgggctaacaagcagggctacttgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6377 - RNA, 9876 nt, synthetic construct
  misc_feature 1..9876: note = derived and/or modified CDS sequence (wt) from DENV-2__JX669484__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagcagtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacgggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggacttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcacgaagagggcatttgtggaatccgctcagtaacaagattggagaatctgatgtggaaacaaataacaccagaattgaatcacatcctatcagaaaatgaggtaaagttgactattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatggcacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttaaagacctgggaagagtgatggttatggtgggcgttgccatgacggatgatataggtatgggagtgacttaccttgccctactagcagctttcaaagttagaccaactttcgcagctggactactcttgagaaaactgacctccaaggaattaatgatggccaccataggaatcacactcctttcccaaagcaccataccagaaaccattcttgaactgactgatgcgttagccttgggcatgatggtcctcaaaatagtgagaaatatggaaaagtaccaattggcagtgaccatcatgactatctcgtgtgtcccaaatgcagtgatactgctaaacgcatggaaggtgagttgcacaatattggcagcggtgtccgtttctccattgctcctaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtgggaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagctcacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggactttaaagggaagactgtttggtttgttccaagtataaaagcaggaaatgacatagcagcttgtctcaggaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggcatcaactacgcagacagaaggtggtgttttgatggaatcaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagatgcactggacaacttagctgtgctgcatacggctgaggcaggtggaagggcgtataatcatgctctcagtgaactgccagagaccctggagacactgcttttactgacactcctggccacagtcacaggaggaatcttcttattcttaatgagcggaaaaggtgtagggaagatgaccctgggaatgtgttgcataatcacggctagcatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatttacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccactgtcaaagatggacatcggagttcccctccttgccattggatgctattcacaggtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaattccagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtggaaaattggttgaacaacaacacccaattttgcataaaagttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtccctatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaataaaccacatgaaaggagaacacaagaaactagccgaggccatattcaaattaacgtaccaaaataaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6378 - RNA, 9876 nt, synthetic construct
  misc_feature 1..9876: note = derived and/or modified CDS sequence (wt) from DENV-2__JX669485__SS-prME
  source 1..9876: mol_type = other RNA
acagcaggcgtgattattatgttgattccaacagcaatggcgttccatttaaccacacgtaatggagaaccacacatgatcgttggtaagcaagagaaagggaaaagtcttctgtttaaaacagaggatggtgtcaacatgtgcaccctcatggccatagaccttggtgaattgtgtgaagacacaatcacgtacaagtgccccctcctcaggcaaaatgaaccagaagacatagattgttggtgcaactccacgtccacatgggtaacttacgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtgctgctgcaaatggaagagaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttaggatctcaagaaggggccatgcacacggcactcacgggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggacttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcacgaagagggcatttgtggaatccgctcagtaacaagattggagaatctgatgtggaaacaaataacaccagaattgaatcacatcctatcagaaaatgaggtaaagttgaccattatgacaggagacattaaaggaatcatgcaggcaggaaaacgatctttgcggccccagcccactgagttgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaacggcacatggaagatggagaaagcctctttcattgaagttaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatagttatggtgggcgttaccatgacggatgatataggtatgggagtgacttaccttgccctactagcagctttcaaagttagaccaactttcgcagctggactactcttgagaaaactgacctccaaggaattaatgatggccaccataggaatcacactcctttcccaaagcaccataccagaaaccattcttgaactgactgatgcgttagccttgggcatgatggtcctcaaaatagtgagaaatatggaaaagtaccaattggcagtgaccatcatggctatctcgtgtgtcccaaatgcagtgatactgctaaacgcatggaaggtgagttgcacaatattggcagtggtgtccgtttctccattgctcctaacatcttcacagcagaaaacggattggataccactggcattgacgataaaaggtctcaatccaacagccatctttctaacaactctttcgagaaccagcaagaaaaggagctggccgctaaatgaagctgtcatggcagttgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaagccgaactggaagatggagcttatagaatcaagcaaagagggattcttggatattctcagattggagccggagtttacaaagaaggaacattccatacaatgtggcacgtcacacgtggtgctgttctgatgcatagagggaaaaggatcgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtatctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaactccagccatcagagccgagcacaccgggcgggagatcgtggacctaatgtgtcatgccacatttactatgaggctgctatcaccagtcagagtgccaaattacaacctgatcatcatggacgaagctcacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaacgattgggactttgtggtcacaactgacatttcagaaatgggtgccaacttcaaggctgagagggttatagaccccagacgttgcatgaaaccagtcatactaacagatggcgaagagcgggtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagagacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcttcagtgaatgtctccctaacagccattgctaaccaagccacagtgctaatgggtcttgggaaaggatggccattgtcaaagatggacatcggagttcccctccttgccattggatgctattcacaggtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggaccttggttgcggcagagggggctggtcatactattgtgggggactaaagaatgtaagagaagtcaaaggcctgacaaaaggaggaccaggacacgaagaacccattcccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacacttagagtcctcaacttagtggaaaattggttgaacaataacacccaattttgcataaaagttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaacatgatttcaaggatgttgattaacagattcacaatgaaacacaagaaagctacctacgagctagatgttgacctaggaagcggaacccgcaacattggaattgaaagtgagacaccaaatctagatataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtgcctatggtgacacagatggcaatgacagacacgactccatttggacaacaacgcgtcttcaaagagaaagtggacacaagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttgagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagtattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagagggtggaacgactggacacaagtgcctttctgttcacaccattttcatgagttagtcatgaaagatggtcgcgtgctcgtagtcccatgcagaaaccaagatgaactgatcggtagagcccgaatttcccagggagccgggtggtctttgaaggagacggcctgtttggggaagtcttacgcccaaatgtggaccctgatgtacttccacagacgtgatctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagttccatacttggggaaaagagaagaccaatggtgcggctcattgatcgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6379 - RNA, 9876 nt, synthetic construct
  misc_feature 1..9876: note = derived and/or modified CDS sequence (wt) from DENV-2__JX669486__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatagaccttggtgaattgtgtgaagatacaatcacgtacaagtgtcccctcctcaggcaaaatgaaccagaagacatagattgttggtgcaactctacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttggaacatggaagttgtgtgacgacgatggcaaaaaacaaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccatgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggtcgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatattaggtgacacagcctgggattttggatccctgggaggagtgttcacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaaactagcttcagctatccaaaaagctcatgaagagggcatttgtggaatccgctcagtaacaagattggagaatctgatgtggaaacaaataacaccagaattgaatcacatcctatcagaaaatgaggtaaagttgaccattatgacaggagacatcaaaggaatcatgcaggcaggaaaaagatctttgcggccccagcccactgagctgaagtactcatggaaaacatggggaaaggcgaaaatgctctccacagagtcccacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagttaaaagctgccactggccaaagtcccacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcgctaggagtcttgggaatggcactgtttctggaagaaatgctcaggacccgagtaggaacgaaacatgcaatactgctagtcgcagtatcttttgtgacattgatcactgggaacatgtcctttagagacttgggaagagtgatggttatggtgggcgttaccatgacggatgatataggtatgggagtgacttaccttgccctattagcagctttcaaagttagaccaactttcgcagctggactactcttgagaaaactgacctccaaggaattaatgatggccaccataggaattacactcctttcccaaagcaccacaccagaaaccattcttgaactgactgatgcgttagccttgggcatgatggtcctaaaaatagtgagaaatatggaaaagtaccaattggcagtgaccatcatgactatcttgtgtgtcccaaatgcagtgatactgctaaacgcatggaaggtgagttgcacaatattggcagtggtgtccgtttctccattgctcctaacatcctcacagcagaaaacggattggataccactggcattgacgataaaaggtctcaatccaacagccatctttctaacaaccctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaatcacggcagcagcatggtacctgtgggaagtgaagaaacaacgggctggagtattgtgggacgtcccttcacccccaccagtggaaaaagccgaactggaagatggagcttatagaatcaagcaaagagggattcttggatattctcagattggagccggagtttacaaagaaggaacattccacacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtgtctctggacttttcccctggaacgtcaggatctccaattgtcgatagaaaaggaaaagttgtgggtctttacggtaatggtgttgtcacaaggagtggagcatatgtgagtgctatagcccagaccgaaaaaagcattgaagacaatccagagatcgaagatgacattttccgaaagaaaagattgaccatcatggatctccatccaggagcaggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgattatcatggacgaagcccacttcacagatccagcaagtatagcagctagaggatatatttcaactcgagtagaaatgggtgaagcagctgggatttttatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggcgccaacttcagggctgagagggttatagaccccagacgttgcatgaaaccagtcatactaacagatggcgaagagcgagtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcttagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggcatcaactacgcagacagaaggtggtgttttgatggaattaagaacaaccagatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgactctgggaatgtgttgcataatcacggctagtgtcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggactgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtggttgacctagaaccaataccctatgatccaaaatttgaaaagcagttaggacaagtaatgctcctaatcctctgcgtgactcaagtgttaatgatgaggactacatgggctctgtgtgaggctctaaccctagcgaccgggcccatctccacactgtgggaaggaaatcctgggaggttttggaacaccaccattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagagaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtccttaacttagtggaaaattggttgaacaacaacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactggatcagcatcatctatggtgaacggagtggtcagactgctgacaaaaccttgggacgtcgtcccaatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaagctaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccgtattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccatttccatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaagagattcagaagggaagaggaagaggcaggtgtcctgtggtag

SEQ ID NO: 6380 - RNA, 9876 nt, synthetic construct
  misc_feature 1..9876: note = derived and/or modified CDS sequence (wt) from DENV-2__JX669487__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgtactctcatggccatagaccttggtgaattgtgtgaagatacaatcacgtacaagtgtcccctcctcaggcaaaatgaaccagaagacatagattgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactttaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcatcgtgacctgtgctatgttcacatgcaaaaagaacatggaaggaaaagtcgtgctgccagagaatcttgaatacactatcatgataacacctcactcaggagaagagcacgctgtaggtaatgacacaggaaaacatggcaaggaaatcaaaataacaccacagagttccatcacagaagcagaactgacaggctatggcactgtcacgatggagtgctctccgagaacgggcctcgacttcaatgagatggtactgctgcagatggaagagaaagcttggctggtgcacaggcaatggttcttagacctgccgttaccatggctacccggagcggacacacaaggatcaaattggatacagaaagagacattggtcactttcaaaaatccccacgcgaagaaacaagacgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggccgcctgattacagttaacccaatcgtaacagaaaaagatagcccagtcaacatagaagcagaacctccattcggagacagttacatcatcataggagtagagccgggacaattgaaactcaattggtttaagaagggaagttccatcggccaaatgtttgagacaacaatgagaggagcgaagagaatggccatattaggcgacacagcctgggattttggatccctgggaggagtgtttacatctataggaaaggctctccaccaagttttcggagcaatctatggggctgcttttagtggggtctcatggactatgaaaatcctcataggagtcatcattacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatcttcatcacagataacgtgcacacgtggacagaacaatataagttccaaccagaatccccttcaaaactagcttcagctatccaaaaagctcatgaagagggcatttgtggaatccgctcagtaacaagattggagaatctgatgtggaaacaaataacaccagaattaaatcacatcctatcagaaaatgaggtaaagttaaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtaaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatggacagattgacaacttttcactaggagtcttgggaatggcactgttcctggaagaaatgctcaggacccgagtaggaacgaaacatgcaatactgctagtcgcagtatcttttgtgacattgattactgggaacatgtcctttagagacctgggaagagtgatggttatggtgggcgttaccatgacggatgacataggtatgggagtgacttaccttgccctactagcagctttcaaagttagaccaactttcgcagctggattactcttgagaaaactgacctccaaggaattaatgatggccaccataggaatcgcactcctttcccaaagcaccataccagaaaccattcttgaactgactgatgcgttagccctgggcatgatggtcctcagaatagtgagaaatatggaaaaataccaattggcagtgaccatcatggctatctcgtgtgtcccaaatgcagtgatactcctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattttagccagttctctcctaaagaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccatatctctggacttttcccctggaacgtcaggatctccaattgtcgatagaaaaggaaaagttgtgggtctttacggcaatggtgttgttacaaggagtggagcatatgtgagtgctatagcccagaccgaaaaaagcattgaagacaatccagagatcgaagacgacattttccgaaagaaaagattgaccatcatggacctccatccaggagcgggaaagacaaaaagataccttccagccatagttagagaagccataaaacgtggcttgagaacattaatcctggctcccactagagttgtggcagctgaaatggaggaagctcttagaggacttccaataagataccaaaccccagccatcagagccgagcacaccgggcgggagatcgtggacctaatgtgtcatgccacattcactatgaggttgctatcaccagtcagagtaccaaattacaacctgatcatcatggacgaagcccacttcacagatccagcaagtatagcagctagaggatatatttcaactcgagtagaaatgggtgaagcagctgggattttcatgacagccactcctccgggaagcagagacccatttcctcagagcaatgcaccaatcatggatgaggaaagagaaattcctgagcgctcatggaattcaggacatgaatgggtcacggattttaaagggaagactgtttggtttgttccaagtataaaagcaggaaatgacatagcagcttgtctcagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgagtaccgtttgagaggagaagcaaggaaaacctttgtggacctaatgagaagaggggacttaccagtctggttggcctacagagtggcagctgaaggcatcaactacgcagacagaaggtggtgttttgatggaatcaagaacaaccaaatactggaagaaaacgtggaagtggaaatctggacgaaagaaggggaaaggaagaaattaaaacccagatggttggatgctaggatctattctgacccactggcactaaaagaattcaaggaatttgcggctggaagaaaatctttgaccctgaacctaatcacagaaatgggtaggcttccaactttcatgactcagaaggcaagagacgcactggacaacttagctgtgctgcatacggctgaggcaggtggaagggcgtacaaacatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagcattctcctatggtatgcacagatacaaccacactggatagcagcttcaataatactggagttttttctcatagttttgctcattccagaaccagaaaaacagagaacaccccaagacaaccaattgacctacgtagtcatagccatcctcacagtggtggccgcaaccatggcaaatgagatgggtttcctggaaaaaactaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaagctctaaccctagcgaccgggcccatctccacactgtgggaaggaaatccagggaggttttggaacactactattgcagtgtcaatggccaacatctttagggggagctacttggccggagctggacttctcttttccatcatgaagaacacaacaaacacaagaagaggaactggcaacataggagagacacttggagaaaaatggaaaagccgattaaacgcactggggaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtgggggactgaagaatgtaagagaagtcaaaggcctgacaaaaggaggaccaggacacgaagaacccatccccatgtcaacatatgggtggaatctagtgcgtctgcaaagtggagttgatgtcttcttcaccccgccagaaaagtgtgatacattgttgtgtgacataggggagtcgtcaccaaatcccacgatagaagcaggacggacactcagagtcctcaacttagcggaaaattggttgaacaacaacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccacggtagctatgaaacaaaacaaactggatcagcatcatctatggtgaacggagtggtcagactgctgacgaaaccttgggacgtcgtccctatggtgacacagatggcaatgacagacacgactccatttggacaacaacgcgtcttcaaagagaaagtggacacgagaacccaagaaccgaaagaaggcacaaagaaactgatgagaatcacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggattcttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaggacttgaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagcgggcaagtcggcacctatggccttaacactttcaccaacatggaagcccaattaattagacagatggaaggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgcgacctcagactggcagcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgcggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6381 - RNA, 9876 nt, synthetic construct
  misc_feature 1..9876: note = derived and/or modified CDS sequence (wt) from DENV-2__JX669488__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgttaacatgtgtaccctcatggccatagaccttggtgaattgtgtgaagatacaatcacgtacaagtgtcccctcctcaggcaaaatgaaccagaagacatagattgttggtgcaactccacgtccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatacaccataggaacgacacatttccaaagggccttgattttcatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaataaaccaacattggattttgaactgataaaaacagaagccaaacaacctgccactttaaggaagtactgtatagaagcaaagctgaccaatacaacaacagaatctcgttgcccaacacaaggggaacccagtctaaatgaagagcaggacaaaaggttcatctgcaaacattccatggtagacagaggatggggaaatggatgtggattatttggaaaaggaggcatcgtgacctgtgctatgttcacatgcaaaaagaacatggaaggaaaagtagtgctgccagagaatctggaatacactatcgtgataacacctcactcaggagaagagcacgctgtaggtaatgacacaggaaaacatggcaaggaaatcaaaataacaccacagagttccatcacagaagcagaactgacaggctatggcactgtcacaatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccacgcgaagaaacaagacgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgtaagatcccttttgagataatggatttggaaaaaagacacgtcttaggccgcctgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcgaagagaatggccatactaggagacacagcctgggattttggatccctgggaggagtgtttacatctataggaaaggctctccaccaagttttcggagcaatctatggggctgcttttagtggggtctcatggactatgaaaatcctcataggagtcatcattacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatcttcatcacagataacgtgcacacgtggacagaacaatataagttccaaccagaatccccttcaaaactagcttcagctatccaaaaagctcatgaagagggcatttgtggaatccgctcagtaacaagattggagaatctgatgtggaaacaaataacaccagaattaaatcacatcctatcagaaaatgaggtaaagttaaccattatgacaggagacattaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggctttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtaaaaagctgccactggccaaagtcacacaccctctggagcaatggagtattggaaagtgagatgataattccaaaaaattttgccgggccagtgtcacaacacaactacagaccaggctaccatacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatggacagattgacaacttttcactaggagtcttgggaatggcactgttcctggaagaaatgctcaggacccgagtaggaacgaaacatgcaatactgctagtcgcagcatcttttgtgacattgattactgggaacatgtcttttagagacctgggaagagtgatggttatggtgggcgctaccatgacggatgacataggcatgggagtgacttaccttgccctactagcagctttcaaagttagaccaactttcgcagctggactactcttgagaaaactgacctccaaggaattaatgatggccaccataggaatcgcactcctttcccaaagcaccataccagaaaccattcttgaactgactgatgcgttagccctgggcatgatggtcctcagaatagtgagaaatatggaaaaataccaactggcagtgaccatcatggctatctcgtgtgtcccaaatgcagtgatactcctaaacgcatggaaggtgagttgcacaatattggcagcggtgtccgtttctccattgctcttaacatcctcacagcagaaaacggattggataccactggcattgacgataaaaggtctcaatccaacagccatctttctaacaactctttcgagaaccagcaagaaaaggagctggccgctaaatgaagctgtcatggcagtcgggatggtgagcattctagccagttctctcctaaaaaatgacattcccatgacaggtccattagtggctggagggctccttactgtgtgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctgggaaaaatccaagagccgtccaaacgaaacctggacttttcaaaaccaacaccggaaccataggcgccatatctctggacttttcccctggaacgtcaggatctccaattgtcgatagaaaaggaaaagttgtgggtctttacggcaatggtgttgtcacaaggagtggagcatatgtgagtgctatagcccagaccgaaaaaagcattgaagacaatccagagatcgaagatgacattttccgaaagaaaagattgaccatcatggacctccatccaggagcgggaaagacaaaaagataccttccagccatagtcagagaagccataaaacgtggcttgagaacgttaatcctggctcccactagagttgtggcagctgaaatggaggaagctcttagaggacttccaataagataccaaaccccagccatcagagccgagcacaccgggcgggagatcgtggacctaatgtgtcatgccacattcactatgaggctgctatcaccagtcagagtaccaaattacaacctgatcatcatggacgaagcccacttcacagatccagcaagtatagcagctagaggatatatttcaactcgagtagaaatgggtgaagcagctgggattttcatgacagccactcctccgggaagcagagacccatttcctcagagcaatgcaccaatcatggatgaggaaagagaaattcctgaacgctcatggaattcaggacatgaatgggtcacggattttaaagggaagactgtttggttcgttccaagtataaaagcaggaaatgacatagcagcttgtctcagaaaaaacggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgggtgattttggcaggacctatgccagtgacccactctagtgcagcacaaagaagagggagaataggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgagtaccgtttgagaggagaagcaaggaaaacctttgtggacctaatgagaagaggggacttaccagtttggttggcctacaaagtggcagctgaaggcatcaactacgcagacagaaggtggtgttttgatggaatcaagaacaaccaaatactggaagaaaacgtggaagtggaaatctggacgaaagaaggggaaaggaagaaattaaaacccagatggttggatgctaggatctattctgacccactggcgctaaaagaattcaaggaatttgcggctggaagaaaatctttgaccctgaacctaatcacagaaatgggtaggcttccaactttcatgactcagaaggcaagagacgcactggacaacttagctgtgctgcatacggctgaggcaggtggaagggcgtacaaacatgctctcagtgaactgccggagaccctggagacactgcttttactgacactcctggccacagtcacaggaggaatcttcttattcttaatgagcggaaaaggtatagggaagatgaccctgggaatgtgttgcataatcacggctagcattctcctatggtatgcacagatacaaccacactggatagcagcttcaataatactggagtttttcctcatagttttgctcattccagaaccagaaaaacagagaacaccccaagacaaccaattgacctacgtagtcatagccattctcacagtggtggccgcaaccatggcaaatgagatgggtttcctggaaaaaaccaagaaagacctcggattgggaagcattacaacccaggaatctgagagcaacatcctggacatagatctacgtcctgcatcagcatggacgctgtatgccgtggctacaacatttgtcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaagctctaaccctagcgaccgggcccatctccacactgtgggaaggaaatccagggaggttttggaacactactattgcagtgtcaatggccaacatctttagggggagctacttggccggagctggacttctcttttccatcatgaagaacacagcaaacacaagaagaggaactggcaacataggagagacacttggagaaaaatggaaaagccgattgaacgcactggggaaaagtgaatttcagatctacaagaaaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagagggggctggtcatactattgtggaggactaaagaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagcggaaaattggttgaacaacaacacccaattttgcataaaggttctcaacccatatatgccttcagtcatagaaaaaatggaaacactacaaaggaaatatggaggagctttagtgaggaatccactctcacgaaactccacacatgagatgtactgggtatccaatgctaccgggaacatagtgtcatcagtgaatatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccacggtagctatgaaacaaaacaaactggatcagcatcatctatggtgaacggagtggtcagactgctgacgaaaccttgggacgtcgtccctatggtgacacagatggcaatgacagacacgactccatttggacaacaacgcgtcttcaaagagaaagtggacacgagaacccaagaaccgaaagaaggcacaaagaaactgatgagaatcacggcagagtggctttggaaagaactaggaaagaaaaagacacctaggatgtgtaccagagaagaattcacaagaaaggtgagaagtaatgcagccttgggggccatattcactgatgaaaacaaatggaaatcggctcgtgaggctgttgaagatagtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttttgaatgaagatcactggttctccagagggaactccctgagtggagtggaaggagaagggctgcacaggctaggctacattttaagagatgtgagcaagaaggaagggggagcaatgtacgccgatgatacagcaggatgggacacaagaatcacactagaggacttaaaaaatgaagaaatggtaacaaaccacatggaaggagaacacaagaaactagccgaggccatattcaaattaacgtaccaaaacaaggtggtgcgtgtgcaaagaccaacaccaagaggcacagtaatggatatcatatctagaaaagaccaaagaggcagcgggcaagtcggcacctatggccttaacactttcaccaacatggaagcccaattaattagacagatggaaggagaaggaatcttcaaaagcattcagcacctgacagtcacagaagaaatcgctgtacagaactggttagcaagagtggggcgtgaaaggctatcaagaatggccatcagtggagatgattgtgttgtaaaacctttagatgacagatttgcaagtgctttaacagctctaaatgacatgggaaaagttaggaaagatatacaacaatgggaaccttcaagaggatggaacgactggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgcgacctcagactggcagcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6382 - RNA, 9876 nt, synthetic construct
  misc_feature 1..9876: note = derived and/or modified CDS sequence (wt) from DENV-2__JX669479__SS-prME
  source 1..9876: mol_type = other RNA
acagcaggcgtgattgttatgttgattccaacagcgatggcgttccatttaaccacacgtaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactcaacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagtcagaaaatttggaatacaccatcgtgataacacctcactcaggagaagagcacgctgtaggtaatgacacaggaaagcacggcaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgaggatggacaaactacagctcaaaggaatgtcatactctatgtgtacagggaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagctacatcatcgtaggagtagagccgggacaactgaaactcaattggtttaagaagggaagttccatcggccaaatgtttgagacaacaatgagaggagcaaagagaatggccattttaggtgacacagcctgggattttggatctctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccatcatgacaggagacattaaaggaatcatgcaggcaggaaaaagatccttgcggcctcagcccactgagctgaagtactcatggaaaacatggggaaaggcgaaaatgctctctacagagtctcacaaccagacctttcttattgatggccctgaaacagcagaatgccccaacacaaacagagcttggaactccctggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgataactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccattggcattgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgttccttcacccccaccagtggaaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgttaagaaagacctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgatagaaaaggaaaagttgtgggtctttacggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccggggagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggtcatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagcatgttcgaaccagagcgtgaaaaggtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacattggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagccacagtgctaatgggtcttgggaaaggatggccattgtcaaagatggacattggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaaggcactgggaaaaagtgaatttcagatctacaagaaaagtggaatccaggaagtggatagaaccctagcaaaagaaggcatcaaaagaggagaaacggaccaccatgctgtgtcacgaggatcagcaaaattgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaacctagacataataggaaagagaatagagaaaataaaacaagagcatgaaacatcatggcattatgaccaagaccacccatacaaaacgtgggcttaccatggcagctatgaaacaaaacaaactgggtcagcatcatctatggtgaacggagtggtcagactgctgacaaaaccttgggacgtcgtccctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctagttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcttgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccggatggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctgggaaaaagggaagaccaatggtgcggctcattgattgggctaacaagcagggctacctgggcaaagaatatccagacagcaataaatcaagtcagatcccttataggcaatgaaggatacacagactacatgccatccatgaagagattcagaagagaagaggaagaggcaggtgtcctgtggtag

SEQ ID NO: 6383 - RNA, 9876 nt, synthetic construct
  misc_feature 1..9876: note = derived and/or modified CDS sequence (wt) from DENV-2__KF744403__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgttcaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccgacattggattttgaactgataaaaacagaagccaaacaacctgccactctaaggaagtactgcatagaggcaaagttaaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataacacctcactcaggggaagagcacgcagttggaaatgacacagggaaacatggcaaggaaatcaaaataacaccacagagttccatcacagaagcagagttgacaggctatggcacagtcacgatggagtgctctccgaggacgggcctcgatttcaatgagatggtgttgttgcaaatggaaaacaaagcttggctggtgcaccggcaatggttcctagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgtaggctgaggatggacaaactacagctcaaaggaatgtcatactccatgtgcacaggaaagtttaaagttgtgaaggaaatagcagaaacacaacatggaacaatagtcgtcagagtacaatatgaaggggacggttctccatgtaagattccctttgagataatggatttggaaaaaagacatgtcttgggccgcctgatcacagtcaacccaattgtgacagaaaaggatagcccagtcaacatagaagcagaacctccattcggagacagctacgtcatcataggagtggagccggggcaattgaagctgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctacggcgctgccttcagcggggtctcgtggactatgaaaatcctcataggagtcattatcacatggataggaatgaattcacgtagcacctcactgtctgtatcactagtattggtgggagtcgtaacactgtacctgggagttgtggtgcaggccgatagtggttgcgttgtgagctggagaaacaaagaactgaaatgtggtagtgggattttcatcacagacaacgtgcacacgtggacagaacaatacaagttccaaccagaatccccctcaaaactagcttcagctatccagaaagctcatcaagagggcatttgtggaatccgctcagtaacgagactggaaaatttgatgtggaaacaaataacaccggaattgaatcacattctatcagaaaatgaggtgaagctgactatcatgacaggagatatcaaaggaatcatgcatgcaggaaaacgatctttgcggcctcagcccactgagctgaggtattcatggaaaacatggggcaaagcgaaaatcctctctacagagtcccataaccagaccttcctcattgatggccccgaaacagcagaatgccccaacacaaacagagcttggaactcacttgaagttgaagactatggctttggagtattcaccaccaatatatggctaaggctgagagaaaagcaggatgcattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctaccatacacaaacagcaggaccatggcatttaggtaagcttgagatggattttgatttctgcaagggaactacagtggtggtgactgaggactgtggaaatagaggaccctccttaagaacaaccactgcctctggaaaactcataacagaatggtgctgcagatcttgcacattgccaccactaagatatagaggtgaggacggatgctggtacgggatggaaatcagaccattgaaagaaaaagaagagaatttggtcagctccttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagcaccataccagagaccattcttgaactgactgatgcgttagccctgggcatgatggtcctcaaaatagtgaggaaaatggaaaggtatcaactggcagtgactattatggctatcttgtgcgtcccaaatgcagtgatattacaaaacgcatggaaagtgagctgcacaatattggcagtggtgtccgtttccccactgctattaacatcctcacagcagaaagcggattggataccattagcattaacgattaaaggtctcaatccaacagctatatttctaacaaccctttcacgaaccagcaagaaaaggagctggccactaaatgaggctatcatggcagtcgggatggtgagcattttagccagttcacttctaaaaaatgacattcccatgacaggaccattggtggctggagggctcctcacagtatgctatgtgctcactggacgatcggccgatttggaattggagaaagctgctgacgtcagatgggaagatcaggcagagatatcaggaagtagtccaatcctatcaataataatatcagaagatggcagcatgtcaataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacctgtgggaaaagctgaactggaagatggagcctacagaatcaagcaaaaagggattctcggatattcccagatcggagccggagtttacaaagaaggaacattccatacaatgtggcacgtcacacgtggtgctgttctaatgcataaaggaaagaggattgagccatcatgggcggacgtcaaaaaagacctaatatcatatggaggaggctggaaactagaaggagaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacggaaaaaagcattgaagacaatccagagattgaagatgacatttttcgaaagaaaagattgaccatcatggacctccacccaggagcaggaaagacgaaaagataccttccggccatagtcagagaagccataaaacggggcctgaggacattaattctggcccccactagagttgtggcagctgaaatggaggaagctcttaggggactcccaataagataccaaaccccagccatcagagccgagcacaccgggcgggagattgtggacctaatgtgtcatgccacattcactatgaggctgctatcgccaattagagtaccaaattacaacttgattatcatggatgaagcccatttcacagacccagcaagtatagcggccagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccattctagtgcagcacaaagaagagggagaataggaagaaatccaaaaaatgaaaacgaccagtacatatatatgggggaacctctggaaaacgacgaagactgtgcacactggaaagaagctaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggggaaaggaagaaattaaaacccaggtggctggacgctaggatctattctgacccattagcgctaaaagaattcaaggaatttgcagctggaagaaagtccctgaccctgaacctaatcacagaaatgggaaggcttccaactttcatgactcagaaggcaagagacgcattggacaacctggcagtgctgcacacggctgaagcaggtggaagggcgtacaatcatgctctcagcgaactgccggagactctggagatattacttttactgacacttctggctacagtcacgggaggaatctttttattcttgatgagcggaagaggtatagggaagatgaccttaggaatgtgctgcataatcacggccagcattcttctatggtacgcacaaatacagccacactggatagcagcttcaataatactggaatttttcctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattaggaagcattacaacccagcaacccgagagcaacatcctggacatagatctacgtcctgcatcagcatggacgctgtatgccgtggccacaacattcatcacaccaatgttgagacatagcattgaaaattcctcagtgaacgtgtccctaacagctattgccaaccaagccacagtgttaatgggtcttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacctagatccaataccctatgatccaaagtttgaaaagcagttgggacaagtaatgctcctagtcctctgtgtgactcaagtattgatgatgaggactacatgggctctgtgtgaagctttaaccttagcgacagggcccatttccacattgtgggaaggaaatccagggaggttttggaacactaccattgcagtgtcaatggctaacatttttagaggaagttacttggctggagctggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatgatcacaccagaagggaaagtagtggaccttggttgcggcagaggaggctggtcatactattgtgggggactaaagaatgtaagagaagtcaaaggcctgacaaagggaggaccagggcacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtgaacggagtggtcagactgctgacaaaaccttgggacgtcatccccatggtgacacagatggctatgacagacacgactccatttggacaacagcgtgtttttaaagagaaagtggacacgagaacccaagaaccgaaagaaggcacaaagaaattaatgaaaatcacggcagaatggctttggaaagaactagggaagaaaaagacacctaggatgtgtactagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcggacaagttggtacctatggactcaacactttcactaatatggaagcccaactaatcagacagatggaaggagaaggagtctttaaaagcattcagcacctgacggccacagaagaaattgccgtgcaaaactggctagcaagagtagggcgcgaaaggttatcaagaatggccatcagtggagatgactgtgtagtgaaacccttagatgacagattcgcaagtgctttaacagctctaaatgacatgggaaaggtcaggaaagacatacaacaatgggaaccttcaaaagggtggaatgattggacacaggtgcccttctgttcacatcatttccatgagttaatcatgaaagacggtcgcgtacttgtagttccatgtagaaaccaagatgaattgattggtagagcccgaatttcccagggagctggatggtctttgcgggagacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6384 - RNA, 9876 nt, synthetic construct
  misc_feature 1..9876: note = derived and/or modified CDS sequence (wt) from DENV-2__KF744406__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgttcaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccgacattggattttgaactgataaaaacagaagccaaacaacctgccactctaaggaagtactgcatagaggcaaagttaaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataacacctcactcaggggaagagcacgcagttggaaatgacacagggaaacatggcaaggaaatcaaaataacaccacagagttccatcacagaagcagagttgacaggctatggcacagtcacgatggagtgctctccgaggacgggcctcgatttcaatgagatggtgttgttgcaaatggaaaacaaagcttggctggtgcaccggcaatggttcctagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgtaggctgaggatggacaaactacagctcaaaggaatgtcatactccatgtgcacaggaaagtttaaagttgtgaaggaaatagcagaaacacaacatggaacaatagtcgtcagagtacaatatgaaggggacggttctccatgtaagattccctttgagataatggatttggaaaaaagacatgtcttgggccgcctgatcacagtcaacccaattgtgacagaaaaggatagcccagtcaacatagaagcagaacctccattcggagacagctacgtcatcataggagtggagccggggcaattgaagctgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctacggcgctgccttcagcggggtctcgtggactatgaaaatcctcataggagtcattatcacatggataggaatgaattcacgtagcacctcactgtctgtatcactagtattggtgggagtcgtaacactgtacctgggagttgtggtgcaggccgatagtggttgcgttgtgagctggagaaacaaagaactgaaatgtggtagtgggattttcatcacagacaacgtgcacacgtggacagaacaatacaagttccaaccagaatccccctcaaaactagcttcagctatccagaaagctcatcaagagggcatttgtggaatccgctcagtaacgagactggaaaatttgatgtggaaacaaataacaccggaattgaatcacattctatcagaaaatgaggtgaagctgactatcatgacaggagatatcaaaggaatcatgcatgcaggaaaacgatctttgcggcctcagcccactgagctgaggtattcatggaaaacatggggcaaagcgaaaatcctctctacagagtcccataaccagaccttcctcattgatggccccgaaacagcagaatgccccaacacaaacagagcttggaactcacttgaagttgaagactatggctttggagtattcaccaccaatatatggctaaggctgagagaaaagcaggatgcattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctaccatacacaaacagcaggaccatggcatttaggtaagcttgagatggattttgatttctgcaagggaactacagtggtggtgactgaggactgtggaaatagaggaccctccttaagaacaaccactgcctctggaaaactcataacagaatggtgctgcagatcttgcacattgccaccactaagatatagaggtgaggacggatgctggtacgggatggaaatcagaccattgaaagaaaaagaagagaatttggtcagctccttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagcaccataccagagaccattcttgaactgactgatgcgttagccctgggcatgatggtcctcaaaatagtgaggaaaatggaaaggtatcaactggcagtgactattatggctatcttgtgcgtcccaaatgcagtgatattacaaaacgcatggaaagtgagctgcacaatattggcagtggtgtccgtttccccactgctattaacatcctcacagcagaaagcggattggataccattagcattaacgattaaaggtctcaatccaacagctatatttctaacaaccctttcacgaaccagcaagaaaaggagctggccactaaatgaggctatcatggcagtcgggatggtgagcattttagccagttcacttctaaaaaatgacattcccatgacaggaccattggtggctggagggctcctcacagtatgctatgtgctcactggacgatcggccgatttggaattggagaaagctgctgacgtcagatgggaagatcaggcagagatatcaggaagtagtccaatcctatcaataataatatcagaagatggcagcatgtcaataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacctgtgggaaaagctgaactggaagatggagcctacagaatcaagcaaaaagggattctcggatattcccagatcggagccggagtttacaaagaaggaacattccatacaatgtggcacgtcacacgtggtgctgttctaatgcataaaggaaagaggattgagccatcatgggcggacgtcaaaaaagacctaatatcatatggaggaggctggaaactagaaggagaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacggaaaaaagcattgaagacaatccagagattgaagatgacatttttcgaaagaaaagattgaccatcatggacctccacccaggagcaggaaagacgaaaagataccttccggccatagtcagagaagccataaaacggggcctgaggacattaattctggcccccactagagttgtggcagctgaaatggaggaagctcttaggggactcccaataagataccaaaccccagccatcagagccgagcacaccgggcgggagattgtggacctaatgtgtcatgccacattcactatgaggctgctatcgccaattagagtaccaaattacaacttgattatcatggatgaagcccatttcacagacccagcaagtatagcggccagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccattctagtgcagcacaaagaagagggagaataggaagaaatccaaaaaatgaaaacgaccagtacatatatatgggggaacctctggaaaacgacgaagactgtgcacactggaaagaagctaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggggaaaggaagaaattaaaacccaggtggctggacgctaggatctattctgacccattagcgctaaaagaattcaaggaatttgcagctggaagaaagtccctgaccctgaacctaatcacagaaatgggaaggcttccaactttcatgactcagaaggcaagagacgcattggacaacctggcagtgctgcacacggctgaagcaggtggaagggcgtacaatcatgctctcagcgaactgccggagactctggagatatcacttttactgacacttctggctacagtcacgggaggaatctttttattcttgatgagcggaagaggtatagggaagatgaccttaggaatgtgctgcataatcacggccagcattcttctatggtacgcacaaatacagccacactggatagcagcttcaataatactggaatttttcctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattaggaagcattacaacccagcaacccgagagcaacatcctggacatagatctacgtcctgcatcagcatggacgctgtatgccgtggccacaacattcatcacaccaatgttgagacatagcattgaaaattcctcagtgaacgtgtccctaacagctattgccaaccaagccacagtgttaatgggtcttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacctagatccaataccctatgatccaaagtttgaaaagcagttgggacaagtaatgctcctagtcctctgtgtgactcaagtattgatgatgaggactacatgggctctgtgtgaagctttaaccttagcgacagggcccatttccacattgtgggaaggaaatccagggaggttttggaacactaccattgcagtgtcaatggctaacatttttagaggaagttacttggctggagctggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatgatcacaccagaagggaaagtagtggaccttggttgcggcagaggaggctggtcatactattgtgggggactaaagaatgtaagagaagtcaaaggcctgacaaagggaggaccagggcacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtgaacggagtggtcagactgctgacaaaaccttgggacgtcatccccatggtgacacagatggctatgacagacacgactccatttggacaacagcgtgtttttaaagagaaagtggacacgagaacccaagaaccgaaagaaggcacaaagaaattaatgaaaatcacggcagaatggctttggaaagaactagggaagaaaaagacacctaggatgtgtactagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcggacaagttggtacctatggactcaacactttcactaatatggaagcccaactaatcagacagatggaaggagaaggagtctttaaaagcattcagcacctgacggccacagaagaaattgccgtgcaaaactggctagcaagagtagggcgcgaaaggttatcaagaatggccatcagtggagatgactgtgtagtgaaacccttagatgacagattcgcaagtgctttaacagctctaaatgacatgggaaaggtcaggaaagacatacaacaatgggaaccttcaaaagggtggaatgattggacacaggtgcccttctgttcacatcatttccatgagttaatcatgaaagacggtcgcgtacttgtagttccatgtagaaaccaagatgaattgattggtagagcccgaatttcccagggagctggatggtctttgcgggagacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6385 - RNA, 9876 nt, synthetic construct
  misc_feature 1..9876: note = derived and/or modified CDS sequence (wt) from DENV-2__KF744404__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgttcaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccgacattggattttgaactgataaaaacagaagccaaacaacctgccactctaaggaagtactgcatagaggcaaagttaaccaacacaacaacagaatctcgctgcccaacacaaggggaacccagcctaaatgaagagcaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataacacctcactcaggggaagagcacgcagttggaaatgacacagggaaacatggcaaggaaatcaaaataacaccacagagttccatcacagaagcagagttgacaggctatggcacagtcacgatggagtgctctccgaggacgggcctcgatttcaatgagatggtgttgttgcaaatggaaaacaaagcttggctggtgcaccggcaatggttcctagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgtaggctgaggatggacaaactacagctcaaaggaatgtcatactccatgtgcacaggaaagtttaaagttgtgaaggaaatagcagaaacacaacatggaacaatagtcgtcagagtacaatatgaaggggacggttctccatgtaagattccctttgagataatggatttggaaaaaagacatgtcttgggccgcctgatcacagtcaacccaattgtgacagaaaaggatagcccagtcaacatagaagcagaacctccattcggagacagctacgtcatcataggagtggagccggggcaattgaagctgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctacggcgctgccttcagcggggtctcgtggactatgaaaatcctcataggagtcattatcacatggataggaatgaattcacgtagcacctcactgtctgtatcactagtattggtgggagtcgtaacactgtacctgggagttgtggtgcaggccgatagtggttgcgttgtgagctggagaaacaaagaactgaaatgtggtagtgggattttcatcacagacaacgtgcacacgtggacagaacaatacaagttccaaccagaatccccctcaaaactagcttcagctatccagaaagctcatcaagagggcatttgtggaatccgctcagtaacgagactggaaaatttgatgtggaaacaaataacaccggaattgaatcacattctatcagaaaatgaggtgaagctgactatcatgacaggagatatcaaaggaatcatgcatgcaggaaaacgatctttgcggcctcagcccactgagctgaggtattcatggaaaacatggggcaaagcgaaaatcctctctacagagtcccataaccagaccttcctcattgatggccccgaaacagcagaatgccccaacacaaacagagcttggaactcacttgaagttgaagactatggctttggagtattcaccaccaatatatggctaaggctgagagaaaagcaggatgcattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctaccatacacaaacagcaggaccatggcatttaggtaagcttgagatggattttgatttctgcaagggaactacagtggtggtgactgaggactgtggaaatagaggaccctccttaagaacaaccactgcctctggaaaactcataacagaatggtgctgcagatcttgcacattgccaccactaagatatagaggtgaggacggatgctggtacgggatggaaatcagaccattgaaagaaaaagaagagaatttggtcagctccttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagcaccataccagagaccattcttgaactgactgatgcgttagccctgggcatgatggtcctcaaaatagtgaggaaaatggaaaggtatcaactggcagtgactattatggctatcttgtgcgtcccaaatgcagtgatattacaaaacgcatggaaagtgagctgcacaatattggcagtggtgtccgtttccccactgctattaacatcctcacagcagaaagcggattggataccattagcattaacgattaaaggtctcaatccaacagctatatttctaacaaccctttcacgaaccagcaagaaaaggagctggccactaaatgaggctatcatggcagtcgggatggtgagcattttagccagttcacttctaaaaaatgacattcccatgacaggaccattggtggctggagggctcctcacagtatgctatgtgctcactggacgatcggccgatttggaattggagaaagctgctgacgtcagatgggaagatcaggcagagatatcaggaagtagtccaatcctatcaataataatatcagaagatggcagcatgtcaataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacctgtgggaaaagctgaactggaagatggagcctacagaatcaagcaaaaagggattctcggatattcccagatcggagccggagtttacaaagaaggaacattccatacaatgtggcacgtcacacgtggtgctgttctaatgcataaaggaaagaggattgagccatcatgggcggacgtcaaaaaagacctaatatcatatggaggaggctggaaactagaaggagaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacggaaaaaagcattgaagacaatccagagattgaagatgacatttttcgaaagaaaagattgaccatcatggacctccacccaggagcaggaaagacgaaaagataccttccggccatagtcagagaagccataaaacggggcctgaggacattaattctggcccccactagagttgtggcagctgaaatggaggaagctcttaggggactcccaataagataccaaaccccagccatcagagccgagcacaccgggcgggagattgtggacctaatgtgtcatgccacattcactatgaggctgctatcgccaattagagtaccaaattacaacttgattatcatggatgaagcccatttcacagacccagcaagtatagcggccagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccattctagtgcagcacaaagaagagggagaataggaagaaatccaaaaaatgaaaacgaccagtacatatatatgggggaacctctggaaaacgacgaagactgtgcacactggaaagaagctaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggggaaaggaagaaattaaaacccaggtggctggacgctaggatctattctgacccattagcgctaaaagaattcaaggaatttgcagctggaagaaagtccctgaccctgaacctaatcacagaaatgggaaggcttccaactttcatgactcagaaggcaagagacgcattggacaacctggcagtgctgcacacggctgaagcaggtggaagggcgtacaatcatgctctcagcgaactgccggagactctgcagatatcacttttactgacacttctggctacagtcacgggaggaatctttttattcttgatgagcggaagaggtatagggaagatgaccttaggaatgtgctgcataatcacggccagcattcttctatggtacgcacaaatacagccacactggatagcagcttcaataatactggaatttttcctcatagttctgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattaggaagcattacaacccagcaacccgagagcaacatcctggacatagatctacgtcctgcatcagcatggacgctgtatgccgtggccacaacattcatcacaccaatgttgagacatagcattgaaaattcctcagtgaacgtgtccctaacagctattgccaaccaagccacagtgttaatgggtcttgggaaaggatggccactgtcaaagatggacatcggagttccccttctcgccattggatgctactcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacctagatccaataccctatgatccaaagtttgaaaagcagttgggacaagtaatgctcctagtcctctgtgtgactcaagtattgatgatgaggactacatgggctctgtgtgaagctttaaccttagcgacagggcccatttccacattgtgggaaggaaatccagggaggttttggaacactaccattgcagtgtcaatggctaacatttttagaggaagttacttggctggagctggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatgatcacaccagaagggaaagtagtggaccttggttgcggcagaggaggctggtcatactattgtgggggactaaagaatgtaagagaagtcaaaggcctgacaaagggaggaccagggcacgaagaacccatccccatgtctacatatgggtggaacctagtgcgtcttcaaagtggagttgacgttttcttcactccgccagaaaagtgcgacacattgctgtgtgacataggggagtcgtcaccaaatcccacggtagaagcaggacggacactcagagtcctcaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtgaacggagtggtcagactgctgacaaaaccttgggacgtcatccccatggtgacacagatggctatgacagacacgactccatttggacaacagcgtgtttttaaagagaaagtggacacgagaacccaagaaccgaaagaaggcacaaagaaattaatgaaaatcacggcagaatggctttggaaagaactagggaagaaaaagacacctaggatgtgtactagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcggacaagttggtacctatggactcaacactttcactaatatggaagcccaactaatcagacagatggaaggagaaggagtctttaaaagcattcagcacctgacggccacagaagaaattgccgtgcaaaactggctagcaagagtagggcgcgaaaggttatcaagaatggccatcagtggagatgactgtgtagtgaaacccttagatgacagattcgcaagtgctttaacagctctaaatgacatgggaaaggtcaggaaagacatacaacaatgggaaccttcaaaagggtggaatgattggacacaggtgcccttctgttcacatcatttccatgagttaatcatgaaagacggtcgcgtacttgtagttccatgtagaaaccaagatgaattgattggtagagcccgaatttcccagggagctggatggtctttgcgggagacagcctgtttagggaagtcttatgcccaaatgtggagcttgatgtacttccacagacgtgacctcaggctggcggcaaatgctatctgctcggcggtcccatcacattgggttccaacaagtagaacaacctggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6386 - RNA, 9876 nt, synthetic construct
  misc_feature 1..9876: note = derived and/or modified CDS sequence (wt) from DENV-2__KF744407__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgttcaaaacagaggatggtgtgaacatgtgtaccctcatggccatggaccttggtgaattgtgtgaagatacaatcacgtataagtgtcctcttctcaggcagaatgaaccagaagacatagattgttggtgcaactctacatccacatgggtaacctatgggacgtgtaccaccacaggagaacacagaagggaaaagagatcagtggcactagtcccacatgtgggaatgggattggagacacgaactgaaacatggatgtcatcagaaggggcctggaaacatgcccagagaattgaaacttggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagattttgtagaaggggtttcaggaggaagctgggttgacatagtcttagaacatggaagctgtgtgacgacaatggccaaaaacaaaccgacattggattttgaactgataaaaacagaagccaaacatcctgccactttaaggaagtattgtatagaggcaaagctgaccaacacaacaacagcatctcgctgcccaacacaaggggaacccagcctaaatgaagagcaggataaaaggttcgtctgcaaacactccatggtagacagaggatggggaaatggatgtggactatttggaaaaggaggcatcgtgacctgtgctatgttcacatgcaaaaagaacatggaaggaaaagtcgtgcaaccagaaaacttggaatataccattgtgataacacctcactcaggggaagagcacgcagttggaaatgacacagggaaacatggcaaggaaatcaaaataacaccacagagttccatcacagaagcagagctgacaggctatggcactgtcacgatggagtgctctccgaggacgggcctcgatttcaatgagatggtgttgctgcaaatggaaaacaaagcttggctggtgcaccggcaatggttcctagatctgccgttgccatggctgcccggagcagacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgtaggctgaggatggacaaactacagctcaaaggaatgtcatactccatgtgcacaggaaagtttaaagttgtgaaggaaatagcagaaacacaacatggaacaatagtcgtcagagtacaatatgaaggggacggttctccatgtaagatcccttttgagataatggatttggaaaaaagacatgtcttaggtcgcttgatcacagtcaacccaattgttacagaaaaggacagcccagtcaacatagaagcagaacctccattcggagacagctacgtcatcataggagtggagccggggcaattgaagctgaattggtttaagaaaggaagttctatcggccaaatgtttgagacaacaatgaggggagcgaagagaatggctattctaggtgacacagcttgggattttggatccctgggaggagtattcacatctataggaaaggctctccaccaggtttttggagcaatctatggggctgccttcagcggggtctcatggactatgaaaatcctcataggagtcattatcacatggataggaatgaattcacgtagcacctcactgtctgtgtcactagtattagtgggggtcgtgacattgtatttgggagtcatggtgcaggccgatagtggttgcgttgcgagctggaaaaacaaagaactgaaatgtggtagtgggattttcatcacagacaacgtgcacacgtggacagaacaatacaagttccaaccagaatccccctcaaaactagcttcagctatccagaaagctcatcaagagggcatttgtggaatccgctcagtaacgagactggaaaatttgatgtggaaacaaataacaccggaattgaatcacattctatcagaaaatgaggtgaagctgactatcatgacaggagatatcaaaggaatcatgcatgcaggaaaacgatctttgcggcctcagcccactgagctgaggtactcatggaaaacatggggcaaagcgaaaatcctctctacagagtcccataaccagaccttcctcattgatggccccgaaacagcagaatgccccaacacaaacagagcttggaactcacttgaagttgaagactatggctttggagtattcaccaccaatatatggctaaggctgagagaaaagcaggatgcattttgcgactcaaaactcatgtcagcggccataaaagacaacagagccgtccatgccgacatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctatcatacacaaacagcaggaccctggcatctaggtaagcttgagatggactttgatttttgtgaaggaaccacagtggtagtgactgaggactgtggaaatagaggaccctctttaagaacaactactgcttctggaaaactcataacagaatggtgctgccggtcttgcacattaccaccgctaaggtacagaggtgaggacggatgctggtacgggatggaaatcagaccattgaaagaaaaagaagagaatttggtcagctccttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctctaaggaattgatgatgactaccataggaatcgtactcctctcccaaagcaccataccagagactatactcgaactgactgacgcgctggctttggggatgatggttctcaaaatagtgagaaacatggaaaagtatcaactagcagtgactattatggctatcttgtgcgtcccaaatgcagtgatattacaaaacgcatggaaagtgagctgcacaatattggcagtggtgtccgtttccccactgctattaacatcctcacagcagaaagcagattggataccattagcgttaacgatcaaaggtctcaatccaacagctatatttctaacaaccctttcacgaaccagcaagaaaaggagctggccactaaatgaggctatcatggcagtcgggatggtgagcattttagccagttcacttctaaaaaatgacattcccatgacaggaccattggtggctggagggctcctcacagtatgctatgtgctcactggacgatcggccgatttggaattggagaaagctgctgacgtcagatgggaagaacaggcagagatatcaggaagtagtccaatcctatcaataataatatcagaagatggcagcatgtcaataaaaaacgaagaggaagaacaaacactgaccatactcattagaacaggattgctggtgatatcaggactttttcctgtatcaataccaatcacggcagctgcatggtacctgtgggaagtgaagaaacaacgggctggagtattgtgggatgtcccttcacccccacctgtgggaaaagccgaactggaagatggagcctacagaatcaagcaaaaagggattctcggatattcccagatcggagccggagtttacaaagaaggaacattccacacaatgtggcacgtcacacgtggtgctgtcctaatgcataaagggaagaggattgagccatcatgggcggacgtcaaaaaagacctaatatcatatggaggaggctggaagctagaaggagaatggaaggaaggagaagaagtccaggtcctggcattggaacctggaaaaaatccaagagccgtccaaacaaaacccggtcttttcaaaaccaatgccggaaccataggtgccgtatctctggacttttcccctggaacgtcaggatcaccaatcattgacaaaaaaggaaaggtggtaggactttatggtaacggcgttgttacaaggaatggatcatatgtgagtgctatagcccagacggaaaaaagcattgaagacaatccagagattgaagatgacatttttcgaaagaaaagattgaccatcatggacctccacccaggagcaggaaagacgaagagataccttccagcaatagtcagagaagccataaaacgaggcttgaggacattaattctggcccccactagagttgtggcagctgaaatggaggaagctcttaggggactcccaataagataccaaaccccagccatcagagccgagcacaccgggcgggagattgtggacctaatgtgtcatgccacattcactatgaggctgctatcgccaattagagtaccaaattacaacttgattatcatggatgaagcccatttcacagacccagcaagtatagcagctagaggatacatttcaactcgagtggaaatgggtgaggcagctgggattttcatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccattctagtgcagcacaaagaagagggagaataggaagaaatccaaaaaatgaaaacgaccagtacatatatatgggggaacctctggaaaacgacgaagactgtgcacactggaaagaagctaaaatgctcctagataacatcaatacacctgaaggaatcattcctagtatgttcgaaccagagcgcgaaaaggtggatgctattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggagaaaggaagaaattaaaacccaggtggctggacgctaggatctattctgacccattagcgctaaaagaattcaaggaatttgcagctggaagaaagtccctgaccctgaacctaatcacagaaatgggaaggcttccaactttcatgactcagaaggcaagagacgcattggacaacctggcagtgctgcacacggctgaagcaggtggaagggcgtacaatcatgctctcagcgaactgccggagactctggagacattgcttttactgacactcttggccacagtcacgggcggaatcttcctattcttgatgagcggaaaaggcatagggaagatgaccctgggaatgtgctgcataatcacggccagtgttctcctatggtatgcacaaatacagccacactggatagcagcttcaataatactggaatttttcctcatagttctgcttattccagaaccagaaaagcagagaacaccccaagataaccaattaacctacgttgtcatagccatcctcacagtggtggccgcaaccatggcaaacgagatgggtttcctggaaaagacaaagaaagatttcggattgggaagcattgcaacccagcaacccgagagcaacatcctggacatagatctacgtcctgcatcagcatggacgctgtatgccgtggccacaacattcatcacaccaatgctgagacatagcattgaaaattcctcagtgaacgtgtccctaacagctattgccaaccaagccacagtgttaatgggtcttgggaaaggatggccactgtcaaagatggacatcggagttccccttctcgccattggatgctattcacaagtcaaccccataacactcacagcagctcttctcttattggtagcacattacgctatcatagggccaggactccaagcaaaagcaaccagagaagctcagaaaagagcagcagcgggcatcatgaaaaatccaactgttgatggaataacagtaatcgacctagatccaataccctatgatccaaagtttgaaaagcagttgggacaagtaatgctcctagtcctctgtgtgactcaagtattgatgatgaggactacatgggctctgtgtgaagctttaaccttagcgacagggcccatttccacattgtgggaaggaaatccagggaggttttggaacactaccattgcagtgtcaatggctaacatttttagaggaagttacctggctggagctggacttctcttttctatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcattaaaagaggagaaacggaccatcacgctgtgtcgcgaggctcagcaaaactgagatggttcgtcgagagaaatatgatcacaccagaagggaaagtagtggaccttggttgcggcagaggaggctggtcatactattgtgggggactaaagaatgtaagagaagtcaaaggcctaacaaaaggaggaccaggacacgaagaacccattcccatgtcaacatatggttggaacctggtgcgtcttcaaagtggagttgatgttttttttactccgccagaaaagtgtgacacactactgtgtgacataggggagtcgtcaccaaaccccacggttgaggcaggacgaacactcagagttctaaacctagtggaaaattggctgaacaacaacacccaattttgcatcaaggttctcaacccatatatgccctcagttatagaaaaaatggaagcgctgcaaaggaaatacggaggagctttggtgaggaatccactctcacgaaattccacacacgagatgtactgggtatccaatgcctccgggaacatagtgtcatcagtgaacatgatttcaaggatgttgatcaacagattcacaatgaaacacaagaaagccacctacgagccagatgttgacctaggaagcggaacccgcaacattggaattgaaagtgaggtaccaaacctggacataattgggaaaagaatagaaaaaataaaacaagagcatgaaacatcatggcactatgaccaagatcacccatacaaaacatgggcttaccatggtagctacgaaacaaaacaaactggatcagcatcatccatggtgaacggagtggtcagactgctgacaaaaccttgggacgtcatccccatggtgacacagatggctatgacagacacgactccatttggacaacagcgtgtttttaaagagaaagtggacacgagaacccaagaaccgaaagaaggcacaaagaaattaatgaaaatcacggcagaatggctttggaaagaactagggaagaaaaagacacctaggatgtgtactagagaagagttcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagacgtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtaccaaaacaaggtggtgcgtgtgcaaagaccaacaccaagaggcacagtaatggatatcatatcaagaagagaccaaagaggtagcggacaagttggcacctacggcctcaatactttcaccaacatggaagcccaactgatcagacagatggaaggagaaggagtctttaaaagcattcagcacctgacggccacagaagaaattgccgtgcaaaactggctaacaagagtagggcgcgaaaggttatcaagaatggccatcagtggagatgactgtgtagtgaaacccttagatgacagattcgcaagtgctttaacagctctaaatgacatgggaaaggtcaggaaagacatacaacaatgggaaccttcaaaagggtggaatgattggacacaggtgcccttctgttcacatcatttccatgagttaatcatgaaagacggtcgcgtacttgtagttccatgcagaaaccaagatgaactgattggtagggcccgaatttcccagggagccgggtggtctttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacttggtccatacatgccaaacatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6387 - RNA, 9876 nt, synthetic construct
  misc_feature 1..9876: note = derived and/or modified CDS sequence (wt) from DENV-2__KF744399__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctgtttaaaacagaggatggtgtgaacatgtgcaccctcatggccatggaccttggtgaattgtgtgaagatacaatcacgtacaagtgtcctcttctcaggcagaatgaaccagaagacatagattgttggtgcaactctacatccacatgggtaacctatgggacgtgtaccaccacaggagaacacagaagagagaaaagatcagtggcactagtcccacatgtgggaatgggattggagacacgaactgaaacatggatgtcatcagaaggggcctggaaacatgcccagagaattgaaacctggattttgagacatccaggctttaccttaatggcagcaatcctggcatacaccataggaacgacaaatttccaaagagccctgatcttcatcttactgacagctgtcgctccttcaatgacaatgcgttgcataggaatatcaaacagagactttgtagaaggggtttcaggaggaagctgggttgacatagtcttagaacatggaagctgtgtgacgacaatggccaaaaacaaaccaacattggatttcgaactgataaaaacagaagccaaacatcctgccactctaaggaagtattgtatagaggcaaagctgaccaacacaacaacagaatctcgctgcccaacacaaggagaacccagcctaaatgaagaacaggataaaaggttcgtctgcaaacactccatggtagacagaggatggggaaatggatgtggactatttggaaaaggaggcattgtgacctgtgctatgtttacatgcaaaaagaacatggaaggaaaaatcgtgcaaccagaaaacttggaatataccatcgtgataacacctcactcaggggaagagaatgcagttggaaatgacacaggaaaacacggcaaggaaattaaagtaacaccacagagttccattacagaagcagaactgacaggctatggcactgtcacgatggaatgctctccgagaacgggcctcggctttaatgagatggtgttgttgcaaatggaaaacaaagcttggctggtgcaccggcaatggttcttagatctgccgttgccatggctgcccggagcggacacacaaggatcaaattggatacagaaagagacattagtcactttcaaaaatccccatgcgaagaaacaagatgttgttgttttaggatcccaagaaggggctatgcatacagcactcacaggggccacagaaatccagatgtcatcagggaacttactgttcacaggacatctcaagtgcaggctgaggatggacaaactacagctcaaaggaatgtcatactccatgtgcacaggaaaatttaaagttgtgaaggaaatagcagaaacacaacatggaacaatagtcgtcagagtacaatatgaaggggacggttctccatgtaagattccctttgagataatggatttggaaaaaagacatgtcttgggccgcctgatcacagtcaacccaattgtgacagaaaaggacagcccagtcaacatagaagcagaacctccattcggagacagctacgtcatcataggagtggagccgggacaactgaagctcagctggtttaagaaaggaagctctattggccaaatgtttgagacaacaatgaggggagcgaagagaatggctattctaggtgacacagcttgggattttggatccctgggaggagtattcacatctataggaaaggccctccaccaagtctttggagcaatctatggggctgcctttagcggggtttcatggactatgaaaatcctcataggagtcgtcatcacatggataggaatgaattcacgcagcacctcactgtctgtgtcactagtattagtgggggtcgtgacattgtatttgggagtcatggtgcaggccgatagtggttgcgttgtgagctggaaaaacaaagaactgaaatgtggtagtgggattttcatcacagacaacgtgcacacatggacagaacaatacaagttccaaccagaatccccttcaaaactagcttcagctatccagaaggctcaccaagagggcatttgtggaatccgctcagtaacaagactggaaaatctgatgtggaaacaaataacaccggaattgaatcacattctatcagaaaatgaggtgaagctgactatcatgacaggagatatcaaaggaatcatgcatgcaggaaaacgatctttgcggcctcagcccactgagctgaggtactcttggaaagcatggggcaaagcgaaaatcctctctacagagctccataaccagaccttcctcattgatggccccgaaacagcagaatgccccaacacaaacagagcttggaactcacttgaagttgaagactatggctttggagtattcaccaccaatatatggctaaagctgagagaaaagcaggatgcattttgcgactcaaaactcatgtcagcggctataaaagacaacagggccgtccatgccgatatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaattacagaccaggctaccatacacaaacagcaggaccatggcatttaggtaagcttgagatggactttgatttctgcaagggaactacagtggtggtgactgaggactgcggaaatagaggaccctccttaagaacaaccactgcctctggaaaactcataacagaatggtgctgtagatcttgcacattgccaccactaaggtacagaggtgaggatggatgctggtatggaatggaaatcaggccattgaaagagaaagaagagaacctggtcaactctttggtcacagccggacatgggcagattgacaacttctcattaggagtcttgggaatggcattgtttctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggcatgggcgtgacttatcttgccctactagcagccttcaaagtcagaccaacttttgcagctggactactcttgagaaagttgacctctaaggaattgatgatgactaccataggaatcgtactcctctcccaaagcaccataccagagactatactcgaactgactgacgcgctggctttggggatgatggttctcaaaatagtgaggaaaatggaaaggtatcaactggcagtgactatcatggctatcttgtgcgtcccaaatgcagtgatattacaaaacgcatggaaagtgagctgcacaatattggcagtagtgtccgtttccccactgctattaacatcctcacagcagaaagcggattggataccattagcattaacgatcaaaggtctcaatccaacagctatattcctaacaaccctttcacgaaccagcaagaaaaggagctggccactaaatgaggctatcatggcagtcgggatggtgagcattttagccagttcactccttaaaaatgacattcccatgacaggaccattggtggctggagggctccttacagtatgctacgtgctcactggacgatcggccgatttggaattggagaaagctgctgacgtcagatgggaagaacaggcagagatatcaggaagtagtccaatcctgtcaataataatatcggaagatggtagcatgtcgataaaaaacgaagaagaagaacaaacactgaccatactcattaggacaggactgctggtgatatcaggactttttcccgtgtcaataccaatcacggcagctgcatggtacctgtgggaagtgaaaaaacaacgagccggagtattgtgggatgtcccttcacccccacctgtgggaaaagctgaactggaagacggagcctacagaatcaagcagaaagggattctaggatactcgcagatcggagctggagtttacaaagaaggaacattccacacaatgtggcacgtcacacgcggtgctgtcctaatgcataaagggaagagacttgaaccatcatgggcggacgtcaagaaagacctaatatcgtatggaggaggctggaaactagaaggagaatggaaggaaggagaagaagtccaggtcctggcattggagcctggaaaaaatccaagagccgtccaaacaaaacccggtctcttcaaaactaacactggaaccataggcgccgtatctctggacttttcccctggaacgtcaggatcaccaatcattgacaaaaaaggaaaggtggtaggactttatggtaacggcgttgtcacaaggaatggatcatatgtgagtgctattgcccagacggaaaaaagcattgaagacaatccagagattgaagatgacatctttcgaaagaaaagattgaccatcatggacctccacccaggagcaggaaagacgaaaagataccttccggccatagtcagagaagccataaaacggggcctgaggacattaattctggcccccactagagttgtggcagctgaaatggaggaagctcttaggggacttccaataagataccaaaccccagccatcagagccgagcacaccgggcgggagattgtggacctaatgtgccatgccacattcactatgaggctgctatcgccaattagagtaccaaattacaacctgattatcatggatgaagcccatttcacagacccagcaagtatagcggccagaggatacatttcaactcgagtggaaatgggtgaggcagctgggatttttatgacagccactcctccggggagcagagacccatttccccagagcaatgcaccaatcatggatgaagaaagagaaatccctgaacgttcgtggaattccggacatgaatgggttacggattttaaagggaagactgtttggttcgttccaagtataaaagcaggaaatgacatagcagcttgcctgagaaaaaatggaaagaaagtgatacaactcagcaggaaaacctttgattctgagtatgtcaagactagaaccaatgactgggactttgtggttacaactgacatttcagaaatgggtgccaacttcaaggctgagagggtcatagatcccagacgctgcatgaaaccagttatactaacagacggtgaagagcgggtgatcctagcaggacccatgccagtgacccactctagtgcagcacaaagaagagggagaataggaagaaatccgaaaaatgaaaacgaccagtacatatacatgggggaacctctggaaaacgacgaagactgtgcacactggaaagaagctaaaatgctcctagataacatcaatacacctgaaggaataattcctagtatgttcgaaccagagcgcgaaaaggtggatgccattgatggtgaataccgcttgagaggagaagcacggaaaacctttgtagacctaatgagaagaggagacctaccagtctggttggcctacaaggtggcagctgaaggcatcaactacgcagacagaaggtggtgttttgatggaatcaggaacaaccaaatcctggaagaaaatgtggaagtggaaatctggacaaaagaaggggaaaggaagaaattaaaacccagatggctggacgccaggatctattctgacccactagcactaaaagaattcaaggaatttgcagctggaagaaagtccctcaccctgaatctaatcacagagatgggtaggcttccaactttcatgactcagaaggcaagagacgcattggacaacctggcagtgctgcacacggctgaagcaggtggaagggcgtacaatcatgctctcagcgaactgccggagactctggagacattgcttttactgacactcttggccacagtcacgggcggaatcttcctattcttgatgagcggaaaaggcatagggaagatgaccctgggaatgtgctgcataatcacggccagtgttctcctatggtacgcacaaatacagccacactggatagcagcttcaataatactggagttttttctcatagtcttgctcattccagaaccagaaaagcagagaacaccccaagataaccaattaacttatgttgtcatagccatccttacagtggtggccgcaaccatggcaaacgagatgggtttcctggaaaagacaaagaaagacttcggattgggaagcattgcaacccagcaacctgagagcaacatcctggacatagatctacgtcctgcatcagcttggactctatatgctgtggcaacaactttcatcacaccaatgctgagacacagcattgaaaattcctcagtgaatgtgtctctaacggccattgccaaccaagccacagttttaatgggtcttgggaaaggatggccattgtcaaaaatggacatcggagttccccttctcgctatcgggtgctattcacaagttaaccctataacactcacagcagctcttctcttattggtagcacattacgctatcatagggccaggactccaagcaaaagcaaccagagaagctcagaaaagagcagcagcgggcatcatgaaaaatccaactgttgatggaataacagtaattgacttagatccaataccctatgatccaaagtttgaaaaacagttgggacaagtaatgctcctagtcctctgtgtgactcaagtattgatgatgaggactacatgggctctgtgtgaagctttaaccttagcgacagggcccatttccacattatgggaaggaaatccagggagattttggaatacaactattgcagtatcaatggctaacatttttagagggagctacctggccggagctggacttctcttttccatcatgaagaacacaaccaacacaagaaggggaactggcaacataggagagacgcttggagaaaaatggaaaagccggttgaacgcattggggaaaagtgaattccagatctacaagaaaagtggaatccaggaagtggatagaacattagcaaaagaaggcatcaaaagaggagaaacggaccatcacgctgtgtcacgaggctcagcaaaactgagatggttcgtcgagagaaacatggtcacaccagaagggaaagtagtggaccttggttgcggcagaggaggctggtcatactattgtgggggactaaagaatgtaagagaagtcaaaggtctgacaaagggaggaccagggcacgaagaacccatccccatgtctacatatggttggaacctggtgcgtcttcaaagtggagttgatgttttttttactccgccagaaaagtgcgacacactgctgtgtgacataggggagtcgtcaccaaaccccacggttgaggcaggacggacactcagagtcctcaacttagtggaaaattggttgaacaacaacacccaattttgcataaaggttctcaacccatacatgccctcagtcatagaaaaaatggaagcactacaaaggaaatatggaggagctttggtgaggaatccactctcacgaaattccacacacgagatgtactgggtatccaatgcctccgggaacatagtgtcatcagtgaacatgatttcaagaatgttgattaacagattcacaatgagacataagaaggccacatacgagccagatgttgacctcggaagcggaacccgtaacatcggaattgaaagtgagataccaaacttggacataattgggaaaagaatagaaaaaataaaacaagagcatgaaacatcatggcactatgaccaagaccacccatacaaaacgtgggcttaccatggtagctatgaaacaaaacaaactggatcagcatcatccatggtgaacggagtggtcagactgctgacaaaaccttgggacgtcatccccatggtgacacagatggctatgacagacacgactccatttgggcaacagcgcgtttttaaagagaaagtggacacgagaacccaagaaccgaaagaaggcacaaagaaattaatgaaaatcacggcagaatggctttggaaagaactagggaagaaaaagacacctaggatgtgtactagagaagaattcacaagaaaggtgagaagcaatgcagccctgggggccatattcactgatgagaacaagtggaagtcggcacgtgaggctgttgaagacagtaggttttgggagctggttgacaaggaaaggaatctccatcttgaaggaaagtgtgaaacatgtgtgtataacatgatgggaaaaagagagaagaagctaggggagttcggcaaggcaaagggcagcagagccatatggtatatgtggcttggagcacgttttttagagtttgaagccctaggattcttgaatgaagatcactggttctccagagagaactccctgagtggagtggaaggagaagggctgcacaagctaggctacatcttaagagaagtgagcaagaaagagggaggagcaatgtatgccgatgacaccgcaggatgggacacaagaatcacactggaagatctaaaaaatgaagaaatggtaacaaaccacatggaaggagaacacaagaaactagctgaggctattttcaaattaacgtatcaaaacaaggtggtgcgtgtgcaaagaccaacaccaagaggcacagtaatggatatcatatcgagaagagaccaaagaggtagcggacaagttggtacctacggcctcaacactttcactaatatggaagcccaactaatcagacagatggaaggagaaggagtcttcaaaagcattcagcacctgacggccacagaagaaaacgccgtgcaaaactggctagcaagagtagggcgcgaaaggttatcaagaatggccatcagtggagatgactgtgttgtgaaacccctagatgacagattcgcaagtgctttaacagctctaaatgacatgggaaaggtcaggaaagacatacaacaatgggaaccttcaagagggtggaatgattggacacaggtgcccttctgttcacatcatttccatgagttaatcatgaaagacggtcgcgtacttgtagttccatgtagaaaccaagatgaactgattggtagggcccgaatttcccagggagccgggtggtctttgcgggaaacagcctgtttggggaagtcttatgcccaaatgtggagcttgatgtacttccacagacgtgacctcaggctggcggcaaatgctatctgctcggcggtcccatcacattgggttccaacaagtagaacaacctggtccatacatgccaaaaatgaatggatgacaacggaagacatgctgacagtctggaacagggtgtggattcaagaaaatccatggatggaagacaagactccagtggaatcatgggaggaaatcccatacttggggaaaagagaagaccaatggtgcggttcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcttgtggtag

SEQ ID NO: 6388 - RNA, 9876 nt, synthetic construct
  misc_feature 1..9876: note = derived and/or modified CDS sequence (wt) from DENV-2__JX286516__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggtttcaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcattgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggctctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagctatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattaggacgggattgttggtgatctcaggagtctttccagtatcgataccaatcacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgatccactggcactaaaaggattcaaggaatttgcagctggcagaaaatctttgaccctgaacctaatcacagaaatgggtaggcttccaacttttatgactcagaaggcaagaaacgcactggacaacttggctgtgctgcatacggctgaggtaggtggaaaggcgtacactcatgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggagattttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacagcaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6389 - RNA, 9876 nt, synthetic construct
  misc_feature 1..9876: note = derived and/or modified CDS sequence (wt) from DENV-2__JX286518__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctccttagacaaaatgaaccagaagacatagattgttggtgcaactctacatccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatttatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcataatcagacctttcttattgatggccctgaaacagcagaatgccccaacacaaacagagcttggaactcactggaagttgaagactatggttttggagtttttaccaccaatatatggctaaaattgagagaaaaacaggatgtgttttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtatgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcttggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcagagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacagagtggcagctgaaggcatcaactacgcagacagaaagtggtgttttgacggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaactcccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagagaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggattaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggctgagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6390 - RNA, 9876 nt, synthetic construct
  misc_feature 1..9876: note = derived and/or modified CDS sequence (wt) from DENV-2__JX286519__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtattaacatgtgtaccctcatggccatagaccttggtgagttgtgtgaagatacaatcacgtacaagtgtcccctcctcagacaaaatgaaccagaagacatagattgttggtgcaactctacatccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttagaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgtaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatttatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcataatcagacctttcttattgatggccctgaaacagcagaatgccccaacacaaacagagcttggaactcactggaagttgaagactatggttttggagtttttaccaccaatatatggctaaaattgagagaaaaacaggatgtgttttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatgataattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctctttaagaacgaccactgcctctggaaagctcataacagaatggtgctgccgatcctgcacactaccacctctaagatacagaggtgaggatggatgctggtatgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagattggagccggagtttacaaagaaggaacattccatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagaccgaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcttggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcagagaagagggagaataggaagaaatccaaaaaatgaaaatgaccagtacatatacatgggggaacctctcgaaaatgatgaagactgtgcacactggaaagaagctaaaatgctcctagataacatcaacacacccgaaggaattgttcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgacggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaagcgcactggacaacttggctgtgctgcatacggctgaggtaggtggaaaggcgtacactcacgctctcagtgaactcccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggattaaagaatgtgagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttatgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttcctatggtgacacagatggcaatgacagacacgactccatttggacaacagcgcgttttcaaagagaaagtggacacgagaactcaagaaccgaaggaaggcacaaagaaactgatgaaaattacggctgagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaagttaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6391 - RNA, 9876 nt, synthetic construct
  misc_feature 1..9876: note = derived and/or modified CDS sequence (wt) from DENV-2__KP188549__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgtaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatggtaattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtgaaaaaagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgacgcgttagccttgggtatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcgataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacattccatacaatgtggcacgtcacacgtggtgctgttctgatgcatagagggaagaggattgaaccatcatgggcagacgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagacagaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacgactgacatttcagaaatgggtgccaacttcaaggctgagagggttatagaccctagacgctgcatgaaaccagtcatactaacagatggcgaagagcgggtgatcttggcaggacctatgccagtgacccactctagtgcagcgcaaagaagagggagaataggaagaaatccaaaaaatgagaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctattcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctggcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgtaacattggaattgaaagtgagacaccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttccaatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgatagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaaccgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaatcaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggattcaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatcaatgaagagattcagaagggaagaggaagaggcaggtgtcctgtggtag

SEQ ID NO: 6392 - RNA, 9876 nt, synthetic construct
  misc_feature 1..9876: note = derived and/or modified CDS sequence (wt) from DENV-2__KP188550__SS-prME
  source 1..9876: mol_type = other RNA
acagcaggcgtgattgttatgttgattccaacagtgatggcgttccatttaaccacacgcaatggagaaccacacatgatcgttggtaggcaggagaaagggaaaagtcttctgttcaaaacagaggatggtgttaacatgtgtaccctcatggccatagaccttggtgaattgtgtgaagatacaatcacgtacaagtgtcccctcctcagacaaaatgaaccagaagacatagattgttggtgcaactctacgtccacatgggtaacttatgggacatgtactaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgtcgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaagaggttcatctgcaaacactccatggtagacagaggatggggaaatggatgtggattatttggaaagggaggcattgtgacctgtgctatgtttacatgcaaaaagaacatggaaggaaaaatcgtacagccagaaaatttggaatacaccatcgtgataacacctcactcaggagaagagcacgctgtaggtaatgacacaggaaagcatggcaaggaaatcaaaataacaccacagagttctaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttaccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagtcaacccaatcgtgacagaaaaagatagcccagtcaacatagaagcagaacctccattcggagacagctacatcatcgtaggagtagagccgggacaactgaaactcaattggtttaagaaaggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagaacaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgctgggccagtgtcacaacacaactacagaccaggctaccatacacaaacagcaggaccttggcatctaggtaagcttgagatggactttgatttctgcgaaggaactacagtggtggtgactgaggactgtggaaatagaggaccctccttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgatgcgttagccttgggcatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcattgacgataaaaggtctcaacccaacagccatttttctaactactctttcgagaaccagcaagaaaaggagctggccgctaaatgaagccatcatggcagtcgggatggtgagcattttagccagttctctcctaaagaatgacattcctatgacaggtccattagtggctggagggctcctcaccgtatgttacgtgctcactggacgatcggccgacttggaactggagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtaaagaaacaacgggctggagtattgtgggacgtcccttcacccccaccagtgggaaaagccgaactggaagatggagcctatagaatcaaacaaagagggattcttggatattctcagattggagccggagtttacaaagaaggaacatttcatacaatgtggcacgtcacacgtggtgctgttctgatgcatagagggaagaggattgaaccatcatgggcagatgtcaagaaagatctaatatcatatggaggaggctggaagctagaaggagaatggaaggaaggagaggaagtccaagtcctggcattggaacctggaaaaaatcccagagctgtccaaacgaaacctggaattttcaaaaccaacaccggaaccataggcgctgtatctctggacttttcccctggaacgtcaggatctccaattgtcgatagaaaaggaaaagttgtgggtctttacggtaatggtgttgtcacaaggagtggagcatacgtaagcgccatagcccagaccgaaaaaagcattgaagacaatccagagatcgaagatgacattttccgaaagaaaagattgaccatcatggacctccatccaggggcaggaaagacaaaaagataccttccagccatagtcagagaagccataaaacgtggcttgagaacattaatcctggctcccactagagtcgtggcagctgaaatggaggaagctcttagaggacttccaataagataccaaaccccagccatcagagccgagcacaccgggcgagagatcgtggacctaatgtgtcatgccacatttactatgaggttgctatcaccagtcagagtgccaaattacaacctgattatcatggacgaagcccacttcacagacccagcaagcatagcagctagaggatacatttcaactcgagtagagatgggtgaagctgccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagctggaaatgacatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccctagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtatatatacatgggggaacctctcgaaaatgatgaagactgtgcacactggaaagaagctaaaatgctcttagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaagggcgcatacccatgctctcagtgaactgccggagactctggagacactgcttctactgacactcctggcaacagtcacaggaggaatcttcttattcttaatgagcggaaaaggtatagggaagatgactctgggaatgtgttgcataatcacagctagcattctcctatggtatgcacagatacaaccacactggatagcagcttcaataatattggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagatctcggatttggaaccattacaactcaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctactcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacaccaccattgcagtgtcaatggctaacatctttagggggagctacttggccggagctggacttctcttttctatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaaccctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagaggaggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaatttagtggaaaattggctgaacaataacacccaattttgcataaaggtcctcaatccatatatgccctcagtcatagaaaaaatggaaacactacaaaggaaatatgggggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgcaacattggaattgaaagtgagataccaaatctagacataataggaaagagaatagagaaaataaaacaagagcatgaaacatcatggcattatgatcaagaccacccatacaaaacgtgggcttaccatggcagctatgaaacaaaacaaactggatcagcatcatctatggtgaatggagtggtcagactgctgacaaaaccttgggacgtcgtccctatggtgacacagatggcaatgacagacacgactccatttggacaacagcgcgtttttaaagagaaagtggacacgagaactcaagaaccgaaggaaggcacaaagaaactgatgaaaattacggcaaagtggctttggaaagaactaggaaaggaaaagacacctagaatgtgtaccagagaagaattcacaagaaaagtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggatttctgaatgaagatcactggttctccagagggaactccctgagtggagtggaaggagaagggttgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaatactttcaccaatatggaagcccaattaattagacagatggaaggagaaggaatcttcaaaaacattcagcacctgaccgccacagaagaaatcgctgtacagaactggttagcaagagtggggcgtgaaaggctatcaagaatggccatcagtggagatgactgtgttgtaaaacctatagatgacagatttgcaagtgctttgacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaaccaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggatccaagaaaacccatggatggaagacaaaactccagtggaatcatgggaagaagtcccatacctggggaaaagggaagaccaatggtgcggctcattgattgggctaacaagcagggctacatgggcaaagaatatccagacagcaataaatcaagtcagatcccttataggcaatgagggatacacagactacatgccatccatgaagagattcagaagggaagaggaagaggcaggtgtcctgtggtag

SEQ ID NO: 6393 - RNA, 9876 nt, synthetic construct
  misc_feature 1..9876: note = derived and/or modified CDS sequence (wt) from DENV-2__KP188553__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgtaaaaagaacatggaaggaaaaatcgtacagccagaaaatttggaatacaccatcgtgataacacctcactcaggagaagagcacgctgtaggtaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaagatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagctgccactggccaaagtcacacaccctatggagcaatggagtattagaaagtgagatggtaattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtgaaaaaagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgacgcgttagccttgggtatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagccatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacattccatacaatgtggcacgtcacacgtggtgctgttctgatgcatagagggaagaggattgaaccatcatgggcagacgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagacagaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgataccctacagtaggaagacttttgactctgagtatgttaagactagagccaatgattgggactttgtggtcacgactgacatttcagaaatgggtgccaacttcaaggctgagagggttatagaccctagacgctgcatgaaaccagtcatactaacagatggcgaagagcgggtgatcttggcaggacctatgccagtgacccactctagtgcagcgcaaagaagagggagaataggaagaaatccaaaaaatgagaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaactgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctattcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctggcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgtaacattggaattgaaagtgagacaccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttccaatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgatagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaaccgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaatcaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggattcaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatcaatgaagagattcagaagggaagaggaagaggcaggtgtcctgtggtag

SEQ ID NO: 6394 - RNA, 9876 nt, synthetic construct
  misc_feature 1..9876: note = derived and/or modified CDS sequence (wt) from DENV-2__KP188556__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgttaacatgtgtaccctcatggccatagaccttggtgagttgtgtgaagatacaatcacgtacaagtgtcccctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaagcatgttcagagaattgaaacctggatcttgagacatccaggttttaccataatggcagcgatcctggcatacaccataggaacgacacacttccaaagggccttgattttcatcttactgacagctgttgctccttcaatgacaatgcgctgcataggaatatcaaatagagacttcgtagaaggggtttcaggaggaagctgggttgacatcgttttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctaaatgaagagcaggacaaaaggttcatctgcaaacactccatggtagacagaggatggggaaatggatgtggattatttggaaagggaggcattgtgacctgtgctatgtttacatgtaaaaagaacatggaaggaaaaatcgtacagccagaaaatttggaatacaccatcgtgataacacctcactcaggagaagagcacgctgtaggcaatgacacaggaaagcatggaaaggaaatcaaaataacaccacagagttccaccacagaagcagaactgacaggctatggcactgtcacgatggagtgctctccgagaacgggcctcgacttcaatgagatggtgctgctgcagatggaagacaaagcttggctggtgcacaggcaatggttcctagacctgccgttgccatggctacccggagcggatacacaaggatcaaattggatacagaaagagacattggtcactttcaaaaatccccacgccaagaaacaggatgtcgttgtcttagggtctcaagaaggggccatgcacacggcactcacaggggctacagaaatccagatgtcatcaggaaacttactgttcacgggacatctcaagtgcaggctgagaatggacaaactacagctcaaaggaatgtcatactctatgtgtacaggaaagtttaaaatcgtgaaggaaatagcagaaacacaacatggaacaatagttatcagagtacaatatgaaggggacggttctccatgcaagatcccttttgagataacagatttggaaaaaagacacgtcttaggacgcctgattacagttaacccaatcgtaacagaaaaagatagcccagtcaacatagaagcagaacccccattcggagacagttacatcatcgtaggagtagagccgggacaactgaaactcaattggtttaagaagggaagttccatcggccaaatgtttgagacaacaatgagaggagcaaagagaatggccattttaggtgacacagcctgggattttggatccctgggaggagtgtttacatctataggaaaggctctccatcaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactgtacctgggagctatggtgcaggctgatagtggttgcattgtgagctggaaaaataaagaactgaaatgtggcagcgggatcttcattacagataacgtacacacatggacagagcaatataagttccaaccagaatccccttcaaaactagcttcagctatccaaaaagctcatgaagaaggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatccttgcggcctcagcccactgagctgaagtactcatggaaaacatggggaaaggcgaaaatgctctctacagagtctcacaatcagacctttcttattgatggccctgaaacagcagaatgccccaacacaaacagagcttggaactcactggaagttgaagactatggttttggagtttttaccaccaatatatggctaaaattgagagaaaaacaggatgtattttgtgactcaaaactcatgtcagcggccattaaagacaacagagccgtccatgccgatatgggttattggatagaaagtgcactcaatgacacatggaagatggagaaagcctccttcattgaagttaaaagttgccactggccaaagtcacacaccctatggagcaatggagtattagaaagtgagatggtaattccaaaaaattttgccgggccagtgtcacaacacaactacagaccaggctaccatacacaaacagcaggaccttggcatctaggtaagcttgagatggactttgatttctgcgaaggaactacagtggtggtgactgaggactgtgaaaaaagaggaccctctttaagaacgaccactgcctctggaaagctcataacagaatggtgctgccgatcctgcacactaccacctctaagatacagaggtgaggatggatgctggtacgggatggaaatcagacctttgaaagagaaagaagagaacttggtcaactccttggtcacagccggacatgggcagattgacaacttttcactaggagtcttgggaatggcactgttcctggaagaaatgcttaggacccgagtaggaacgaaacatgcaatactgctagttgcactatctttcgtgacattgattactgggaacatgtcttttagagacctgggaagagtgatggtcatggtgggcgctaccatgacggatgacataggtatgggagtgacttatcttgccctactagcagctttcaaagttagaccaacttttgcagctggactactcttgagaaaactgacctccaaggaattgatgatggccaccataggaatcgcactcctttcccaaagcaccttgccagagaccattctagaactgactgacgcgttagccttgggtatgatggccctcaaaatagtgagaaatatggaaaaataccaattggcagtgactatcatggctatttcgtgtgtcccaaatgcagtgatattgcaaaacgcatggaaggtgagttgcacaatattggcagcggtgtccgtttctccactgctcctaacatcctcacagcagaaagcggattggataccactggcactgacgataaaaggtctcaacccaacagccatttttctaacaactctttcgagaaccagcaagaaaaggagctggccgctaaatgaagctatcatggcagtcgggatggtgagcattttagccagttctctcctaaagaatgatattcctatgacaggtccattagtggctggagggctcctcaccgtatgttacgtgctcactggacgatcggccgatttggaactggagagagctgccgatgtaaaatgggaagatcaggcagaaatatcaggaagcagcccaattctgtcgataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtgggaaaagccgaactggaagatggagcctatagaatcaagcaaagagggattcttggatattctcagatcggagccggagtttacaaagaaggaacattccatacaatgtggcacgtcacacgtggtgctgttctgatgcatagagggaagaggattgaaccatcatgggcagacgtcaagaaagatctaatatcatatggaggaggctggaagctagaaggagaatggaaggaaggagaggaagttcaagtcctggcattggaacctggaaaaaatcccagagctgtccaaacgaaacctggaattttcaaaaccaacaccggaaccataggcgctgtatctctggacttttcccctggaacgtcaggatctccaattgtcgacagaaaaggaaaagttgtgggtctttatggtaatggtgttgtcacaaggagtggagcatacgtaagtgccatagcccagacagaaaaaagcattgaagacaatccagagatcgaagatgacattttccgaaagaaaagattgaccatcatggacctccatccaggggcaggaaagacaaaaagataccttccagccatagttagagaagccataaaacgtggcttgagaacattaatcctggctcccactagagtcgtggcagctgaaatggaggaagctcttagaggactcccaataagataccaaaccccagccatcagagccgagcacaccgggcgagagatcgtggacctaatgtgtcatgccacatttactatgaggctgctatcaccagtcagagtgccaaattacaacctgattatcatggacgaagcccacttcacagacccagcaagcatagcagctagaggatacatttcaactcgagtagagatgggtgaagcagccgggatttttatgacagccactcctccgggaagcagagacccatttcctcagagcaatgcaccaatcatggatgaggaaagagaaatccctgagcgttcatggaattcaggacatgaatgggtcacggattttaaagggaagactgtttggtttgttccaagtataaaagcaggaaatgacatagcagcttgtcttaggaaaaatggaaagaaagtgatacaactcagtaggaagacttttgactctgagtatgttaagactagagccaatgattgggactttgtggtcacgactgacatttcagaaatgggtgccaacttcaaggctgagagggttatagaccctagacgctgcatgaaaccagtcatactaacagatggcgaagagcgggtgatcttggcaggacctatgccagtgacccactctagtgcagcgcaaagaagagggagaataggaagaaatccaaaaaatgagaatgaccagtacatatacatgggggaacctctcgaaaatgatgaagactgtgcacactggaaagaagctaaaatgctcctagataacatcaacacacccgaaggaattattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatgtggaagtggaaatctggacaaaagaaggggaaaggaaaaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttggctgtgctgcatacggctgaggtaggtggaaaggcgtacactcacgctctcagtgaattgccggagactctggagacactgcttctactgacactcctggcagcagtcacaggaggaatcttcttattcttaatgagcggaaaaggtatagggaagatgactctgggaatgtgttgcataatcacagctagcattctcctatggtatgcacagatacaaccacactggatagcagcttcaataatactggagttttttctcatagttttgctcattccagaaccagaaaaacagagaacaccccaagacaaccaattgacctacgttgtcatagccatcctcacagtggtggccgcaaccatggcaaacgagatgggtttcctggaaaaaaccaagaaagacctcggatttggaagcattacaacccaggaatctgagagcaacatcctggacatagatctacgtcctgcatcagcatggacgctgtatgccgtggctacaacatttgtcacaccaatgttgcgacatagcattgaaaattcctcagtaaatgtctccctaacagccattgctaaccaagctacagtgctaatgggtcttgggaaaggatggccattgtcaaagatggacatcggagttcccctccttgccattggatgctattcacaagtcaaccctataaccctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccccatgatccaaaatttgaaaagcagttaggacaagtaatgctcctaatcctctgcgtgactcaagtattaatgatgaggactacatgggctttgtgtgaggctctaaccctggcgaccgggcccatctccacactgtgggaaggaaatccagggaggttttggaacaccaccattgcagtgtcaatggctaacatctttagggggagctacttggccggagctggacttctcttttccatcatgaagaacacaacaaacacaagaagaggaactggcaacgtaggagagacacttggagaaaaatggaaaagccgattaaatgcactgggaaaaagtgaatttcagatctacaagaaaagtggaatccaggaagtggatagaactctagcaaaagaaggcatcaaaagaggagaaacggaccaccatgctgtgtcacgaggatcagcaaaactgagatggttcgtcgagagaaacatggtcacaccggaagggaaggtggtggatcttggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggggtcgacgttttcttcaccccgccagaaaagtgtgatacattgttgtgtgacataggggagtcgtcaccaaatcccacgatagaagcaggacgaacactcagagtcctcaacttagtggaaaattggctgaacaataacacccaattttgcataaaggtcctcaatccatatatgccctcagtcatagaaaaaatggaaacactacaaaggaaatatggaggagccttagtgaggaatccactctcacgaaactccacgcatgaaatgtactgggtatctaatgctaccgggaacatagtgtcatcagtgaacatgatttcaaggatgttgattaacagattcacaatgaaacataagaaagccacctacgagccagatgttgacctaggaagtggaacccgtaacattggaattgaaagtgagacaccaaatctagacataataggaaagagaatagagaaaataaaacaagagcatgaaacatcatggcattatgaccaagaccacccatacaaaacgtgggcttaccatggcagctatgaaacaaaacaaactggatcagcatcatctatggtgaacggagtggtcagactgctgacaaaaccttgggacgtcgttccaatggtgacacagatggcaatgacagacacgactccatttggacaacagcgcgttttcaaagagaaagtggacacgagaactcaagaaccgaaggaaggcacaaagaaactgatgaaaattacggcagagtggctttggaaagaactaggaaaggaaaagacacctagaatgtgtaccagagaagaattcacaagaaaagtgagaagcaatgcagccttgggggccgtattcactgatgagaacaaatggaaatcggcacgtgaggctgttgaagatggtaggttttgggagctggttgatagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgctttttagagtttgaagccctaggatttctgaatgaagatcactggttctccagagggaactccctgagtggagtggaaggagaagggctgcacaggctaggctacattttaagagaggtgggcaagaaggaaggaggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacaccaagaggcacagtaatggatatcatatcgagaaaagaccaaagaggcagtgggcaagtcggtacctatggccttaacactttcaccaatatggaagcccaattaattagacagatggaaggagaaggaatcttcaaaagcattcagcacctgaccgccacagaagaaaccgctgtacagaactggttagcaagagtggggcgtgaaaggctatcaagaatggccatcagtggagatgactgtgttgtaaaacctatagatgacagatttgcaagtgctttaacagctctaaatgacatgggaaaagttaggaaagatatacaacaatgggaaccttcaagaggatggaacgattggacacaggtgcctttctgttcacaccattttcatgagttagtcatgaaagatggtcgcgtgctcgtagtcccatgcagaaatcaagatgaactgattggcagagcccgaatttcccagggagccgggtggtctttgaaggagacggcttgtttggggaagtcttacgcccaaatgtggaccctgatgtacttccacagacgtgacctcagattggcggcaaatgccatttgctcggcagtcccgtcacattgggttccaacaagtcgaacaacctggtccatacacgccaagcatgaatggatgacgacggaagacatgctggcagtctggaacagggtgtggattcaagaaaacccatggatggaagacaaaactccagtggaatcatgggaagaagtcccatacctggggaaaagggaagaccaatggtgcggctcattgattgggctaacaagcagggctacctgggcaaagaatatccagacagcaataaatcaagtcagatcccttataggcaatgagggatacacagactacatgccatcaatgaagagattcagaagggaagaggaagaggcaggtgtcctgtggtag

SEQ ID NO: 6395 - RNA, 9876 nt, synthetic construct
  misc_feature 1..9876: note = derived and/or modified CDS sequence (wt) from DENV-2__GU369819__SS-prME
  source 1..9876: mol_type = other RNA
acagcaggcgtgattgttatgttgattccaacagcgatggcgttccatttaaccacacgcaatggagaaccacacatgatcgttggtaggcaggagaaagggaaaagtcttctgttcaaaacagaggatggtgtcaacatgtgtaccctcatggccatagaccttggtgaattgtgtgaagatacaatcacgtacaagtgtcctctcctcagacaaaatgaaccagaagacatagattgttggtgcaactccacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgtccagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaacacaacaacagaatcgcgttgcccaacacaaggggaacccagtctgaatgaagagcaggacaaaaggttcatctgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggcactgtcacgatggagtgctctccgagaacgggcctcgacttcaatgagatggtgttgctgcagatggaaaacaaagcttggctggtgcacaggcaatggttcctagacctgccgctaccatggctgcccggagcggacacacaaggatcaaattggatacagaaagagacattggtcactttcaaaaatccccacgcgaagaaacaggatgtcgttgttttagggtctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggttctccatgtaagatcccttttgagataacagatttggaaaaaagacacgtcttaggtcgcttgattacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacaatgagaggagcaaagagaatggccattttaggtgacacagcctgggactttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggcgtcgtgacactgtacctgggagctatggtgcgagctgatagtggttgcgttgtgagctggaaaaacaaagaactgaaatgtggcagcgggatcttcatcacagataacgtacacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccatcatgacaggagacattaaaggaatcatgcaggcaggaaaacgatccttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgctggaagttgaagactatggttttggagttttcaccaccaatatatggctgaaattgagagaaaaacaggatgtattttgtgactcaaaactcatgtcagcggccattaaagacaacagagccgttcatgccgatatgggttattggatagaaagtgcactcaatgacacatggaagatggagaaggcctccttcattgaagttaaaagctgccactggccaaagtcacacaccctttggagcaatggagtattagaaagtgagatgataatcccaaaaaattttgccgggccagtgtcacaacacaactacagaccaggctaccatacacaaacagcaggaccttggcatctaggtaagcttgagatggactttgatctttgcgaaggaactacagtggtggtgactgaggactgtggaaatagaggaccctctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaactccttggtcacagccggacatgggcagattgacaacttttcactaggagtcttgggaatggcactgttcctggaagaaatgctcaggacccgaataggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagcttttaaagttagaccaacttttgcagctggactactcttgagaaaactgacctccaaggaattgatgatggccaccataggaatcgcactcctttcccaaagcaccataccagagaccattcttgaactgactgatgcgttagccttgggcatgatggtcctcaaaatagtgagaaatatggaaaaataccaattggcagtgactatcatggctatttcgtgtgtcccaaatgcagtgatactgcaaaacgcatggaaggtgagttgcacaatattggcagcggtgtccgtttctccactgctcttaacatcctcacagcagaaagcggattggataccactggcattgacgataaaaggtctcaatccaacagccatttttctaacaactctttcgagaaccagcaagaaaaggagctggccgctaaatgaagctatcatggcagtcgggatggtgagcattttagccagttctctcctaaagaatgatattcccatgacaggtccattagtggctggagggctccttaccgtatgttacgtgctcactggacgatcggccgatttggaactggagagagctgccgatgtaaaatgggaagatcaggcagaaatatcaggaagcagcccaatcctatcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccacctgtgggaaaggctgaactggaagatggagcctatagaatcaagcaaaaagggattcttggatattcccagatcggagccggagtttacaaagaaggaacattccatacaatgtggcacgtcacacgtggtgctgttctgatgcatagagggaagaggattgaaccatcatgggcagatgtcaagaaagacctaatatcatatggaggaggctggaagctagaaggagaatggaaggaaggagaggaagtccaagtcctggcattggaacctggaaaaaatccaagagccgtccaaacgaaacctggaattttcaaaaccaacaccggaaccataggcgccgtatctctggacttttcccctggaacgtcaggatctccaattgtcgacagaaaaggaaaagttgtgggtctttacggtaatggtgttgtcacaaggagtggagcatatgtaagtgccatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattgatcctggctcccactagagtagtggcagctgaaatggaggaagctcttagaggacttccaataagataccaaaccccagccatcaaaaccgagcataccgggcgggagatcgtggacctaatgtgtcatgccacatttactatgaggctgctatcaccagtcagagtgccaaattacaacctgatcatcatggacgaagcccacttcacagacccagcaagtatagcagctagaggatacatttcaactcgagtagagatgggtgaagcagccgggattttcatgacagccactcctccgggaagtagagacccatttcctcagagcaatgcaccaatcatggatgaggaaagagaaattcctgagcgttcgtggaattcaggacacgaatgggtcacggattttaaggggaagactgtttggtttgttccaagtataaaagcaggaaatgatatagcagcttgtcttaggaaaaatggaaagaaagtgatacaactcagtaggaagacttttgactctgagtatgttaagactagagccaatgattgggactttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctcttgaaaatgatgaagactgtgcacattggaaagaagctaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttggcctacaaagtggcagctgaaggcatcaactacgcagacagaaagtggtgttttgatggaattaagaacaaccaaatactggaagaaaatatagaagtggaaatctggacaaaagaaggggaaaggaaaaaattaaaacccagatggttggatgctaggatctattctgacccactggcactaaaagaattcaaggaatttgcagctggaagaaaatctctgaccctgaacctaatcacagaaatgggtaggcttccaactttcatgactcagaaagcaagaaacgcactggacaacttggctgtgctgcatacggctgaggcaggtggaagggcgtacaatcatgctctcagtgaactgccggagaccctggagacactgcttttactgacactcctggcaacagtcacaggaggaatctttttattcttgatgagcggaaggggcatagggaagatgaccctgggaatgtgctgcataatcacggctagtatcctcctatggtatgcacagatacaaccacactggatagcagcttcaataatactggagttttttctcatagttttgctcattccagaaccagaaaaacagagaacaccccaagacaaccaattgacctacgttgtcatagccattctcacagtggtggccgcaaccatggcaaacgagatgggtttcctggaaaaaaccaagaaagacctcggattgggaagcattacaacccaggaatctgagagcaatatcctggacatagatctacgccctgcatcagcatggacgctgtatgccgtggctacaacatttgtcacaccaatgttgagacatagcattgaaaattcctcagtgaatgtctccctaacagccattgctaaccaagctacagtgctaatgggtcttgggaaaggatggccattgtcaaagatggacattggagttcccctccttgccattggatgctattcacaagtcaaccctataactctcacagcagctcttcttttattggtagcacattatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaaaaacacaacaaacacaagaagaggaactggcaacataggagagacacttggagaaaaatggaaaagtcgattaaacgcactgggaaaaagtgaatttcaagtctacaagaaaagtggaatccaggaagtggatagaaccctagcaaaagaaggtatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacatgaagaacccatccccatgtcaacatatgggtggaatctagtgcgtttgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccttcagtcatagaaaaaatggaagcattacaaaggaaatatggaggagccttagtgaggaatccactctcacgaaactccacgcatgaaatgtactgggtatctaatgccaccgggaacatagtgtcatcagtgaacatgatttcaaggatgttgattaacagattcacaatgaaacacaagaaagccacttacgagccagatgttgacctaggaagtggaacccgcaacattggaattgaaagtgagataccaaatctagacataataggaaagagaatagagaaaataaagcaagagcatgaaacatcatggcactatgaccaagaccacccatacaaaacgtgggcataccatggcagctatgaaacaaaacagactggatcagcatcatccatggtgaacggagtggtcaggctgctgacaaaaccttgggacgtcctccccatggtgacacagatggcaatgacagacacgactccatttggacaacagcgcgttttcaaagagaaagtggacacgagaacccaagaaccgaaagaaggcacgaagaaactaatgaaaatcacggcagagtggctgtggaaagaactaggaaagaaaaagacacctaggatgtgcaccagagaagaattcacaagaaaggtgagaagcaatgcagccttgggggccatattcactgatgagaacaagtggaagtcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgggcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaggtggtgcgtgtgcaaagaccaacgccaagaggcacagtaatggatatcatatcgagaagagaccaaagaggcagtgggcaagtcggcacctatggccttaatactttcaccaatatggaagcccaattaattagacagatggagggagaaggaatcttcaaaagcattcagcacctgacagccacagaagaaatcgctgtacagaactggttagcaagagtggggcgtgaaaggctatcaagaatggcaatcagtggggatgattgtgttgtaaaacctatagatgatagatttgcaagtgctttaacagctctaaatgacatgggaaaagttagaaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagctgggtggtctttgaaggagacggcctgtttggggaagtcttacgcccaaatgtggaccctgatgtacttccacagacgtgacctcagactggcggcaaatgccatttgctcggcagtcccgccacattgggttccaacaagtcgaacaacctggtccatacacgctaagcatgaatggatgacgacggaagacatgctggcagtctggaacagggtgtggatccaagaaaacccgtggatggaagataaaactccagtggaatcatgggaagaagtcccatacttgggaaaaagagaagaccaatggtgcggctcattgattgggctaacaagcagggctacctgggcaaagaacatccaaacagcaataaaccaagtcagatcccttataggcaatgaggaatacacagactacatgccatccatgaagagattcagaagggaagaggaagaggcaggtgtcctgtggtag

SEQ ID NO: 6396 - RNA, 9876 nt, synthetic construct
  misc_feature 1..9876: note = derived and/or modified CDS sequence (wt) from DENV-2__JX649147__SS-prME
  source 1..9876: mol_type = other RNA
acagcaggcgtgattattatgttgattccaacagcgatggcgttccatttaaccacacgtaacggagaaccacacatgatcgttggtagacaagagaaagggaaaagtcttctgttcaaaacagaggatggtgtgaacatgtgtaccctcatggccatagatcttggtgaactgtgtgaagatacaatcacgtacaagtgccccctcctcaggcagagtgaaccagaagacatagattgttggtgcaactccacgtccacatgggtaacttatgggacgtgtaccaccacaggagaacatagaagagaaaaaagatcagtggcactcgttccacatgtgggtatgggattggagacacgaactgaaacatggatgtcgtcagaaggggcctggaaacacgctcagagaattgaaacctggatcttgagacatccaggctttaccataatggcagcaatcctggcatacaccataggaacgacacatttccaaaaggccctgattttcatcttactgacagctgtcgctccttcaatgacaatgcgttgcataggaatatcaaatagagactttgtagaaggggtttcaggaggaagctgggttgacatagtcttagaacatggaagttgtgtgacgacaatggcaaaaaacaaaccaacattggattttgaactgataaaaacagaagccaaggaacctgccactctaaggaagtactgtatagaagcaaagctgaccaacacaacaacagaatctcgttgcccaacacaaggggaacccagtctaaatgaagagcaggacaaaaggttcgtctgcaaacactccatggtagacaggggatggggaaatggatgtggattatttggaaagggaggcattgtgacctgtgctatgttcacatgcaaaaagaacatggaaggaaaaatcgtgcaaccagaaaatttggaatacaccatcgtgataacacctcactcaggagaagagcacgctgtaggtaatgacacaggaaaacatggtaaggaaatcaaaataacaccacagagttccatcacagaagcagaactgacaggctatggcacagtcacgatggagtgctctccgagaacgggccttgacttcaatgagatggtgctgctgcagatggaagacaaagcttggctggtgcacaggcaatggttcctagacctgccgttaccatggctacccggagcggacacacaaggatcaaattggatacagaaagagacattggtcactttcaaaaatccccacgcgaagaaacaggatgtcgttgttttgggatctcaagaaggggccatgcacacggcactcacaggggccacagaaatccagatgtcatcaggaaacctactatttacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggagacggctctccatgtaagatcccttttgaaataatggatttggaaaaaagacatgtcttaggtcgcctgattacagttaacccgatcgtaacagaaaaagatagcccagtcaacatagaagcagaacctccattcggagacagctatatcatcataggagtagagccgggacaattgaaactcaactggtttaagaaaggaagttccatcggccaaatgtttgagacaacaatgagaggagcgaagagaatggccattttaggtgacacagcctgggattttggatccctgggaggagtgtttacatctataggaaaggctctccaccaagttttcggagcaatctatggggctgccttcagtggggtctcatggactatgaaaatcctcataggagtcatcatcacatggataggaatgaattcacgtagcacctcactgtctgtgtcactagtattggtgggagtcataacactgtacctaggagccatggtgcaggctgatagtggttgcgttgtgagctggaaaaacaaagaactgaaatgtggtagcgggatcttcatcacagataacgtgcacacatggacagaacaatataagttccaaccagaatccccttcaaaactagcttcagccatccaaaaagctcatgaagaaggcatttgtggaatccgctcagtaacaagattggagaatctgatgtggaaacaaataacaccagaattgaatcacattctatcagaaaatgaggtaaagttgaccattatgacaggagacatcaaaggaatcatgcaggcaggaaaacgatctctgcggccccagcccactgagctgaagtattcatggaaaacatggggaaaggcgaaaatgctctccacagagtctcacaaccagacctttctcattgatggccctgaaacagcagaatgccccaacaaaaacagagcttggaactcgctggaagttgaagactatggttttggagtcttcaccaccaatatatggctaaaattgagagaaaaacaggatgtgttttgtgactcaaaactcatgtcagcagccataaaagacaatagagccgtccatgccgatatgggttattggatagaaagtgcactcaatgacacatggaagatggagaaggcctcttttattgaagttaaaagctgccactggccaaagtcacacaccctctggagtaatggagtattagaaagtgagatgataattccaaaaagttttgctgggccagtgtcacaacacaactacagaccaggctattacacgcaaacagcaggaccttggcatctaggtaagcttgagatggactttgatttctgcgaaggaactacagtggtggtgactgaagactgcggaaatagaggaccctctttaagaacgaccactgcctctggaaaactcataacagaatggtgctgccgatcctgcacattaccacctctaagatacagaggtgaggatggatgctggtatgggatggaaatcagaccattaaaagagaaagaagagaatttagtcaactccttggtcacagccggacatgggcagattgacaacttttcactaggagtcttaggaatggcactattcctggaagaaatgctcaggacacgagtaggaacgaaacatgcaatactgctagttgcagtttcttttgtgacattgattactgggaacatgtcctttagagacctgggaagagtgatggttatggtgggcgctaccatgacggatgacataggtatgggagtgacttatcttgccctactagcagctttcaaagttagaccaacttttgcagctggactactactgaaaaagctgacctccaaggaattaatgatggctaccataggaatcgcactcctttctcaaagcaccataccagagaccattcttgaactaactgatgcgttagccttgggcatgatggtccttaaaatagtgagaaatatggaaaagtatcaattggcagtgactatcatggccatctcgtgcgtcccaaatgcagtgatactgcaaaacgcatggaaggtgagctgcacaatattggcagcggtgtccgtttctccactgcttttaacatcctcacagcagaaagcggattggataccactggcattgacgataaaaggtctcaatccaacagccatttttctaacaactctttcgagaaccagcaagaaaaggagctggccgctaaacgaagctatcatggcagtcgggatggtgagcattttagccagttctctcttaaagaatgacattcccatgacaggtccattagtggccggagggctccttactgtgtgttacgtgctcactggacgatcggccgatttggaactggagagagccaccgatgtcaaatgggaagatcaggcagaaatatcaggaagcagcccaatcctgtcaataacaatatcagaagatggcagcatgtcgataaaaaatgaagaggaagaacaaacactgaccatactcatcagaacgggattgctagtgatctcaggactctttccaatgtcaataccaattacagcagcagcatggtacctgtgggaagtgaagaaacaacgggctggagtattgtgggacgtcccttcacccccacccgtgggaaaggccgaactggaagatggagcctatagaatcaagcaaaaagggattcttggatattctcagattggagccggagtttacaaagaaggaacattccatacaatgtggcacgtcacacgtggcgctgttctgatgcatagagggaagaggattgaaccatcatgggcggacgtcaagaaagacctaatatcatatggaggaggctggaagctcgaaggagaatggaaggaaggagaggaagtccaagtcctggcattggaacctggaaaaaatccaagagctgtccaaacgaaacctggacttttcaaaaccaacaccggaaccataggcgctgtatctctggacttttcccccggaacgtcaggatctccaattgtcgatagaaaaggaaaagttgtgggtctttatggcaatggtgttgtcacaaggagtggagcatacgtgagtgctatagcccagaccgagaaaagcattgaagacaatccagagatcgaagatgacattttccgaaagaaaagattgaccatcatggacctccatccaggagcgggaaagacaaaaagataccttccagccatagttagagaggccataaaacgtggcttgagaacattaatcctggcccccactagagtcgtggcagctgaaatggaggaagctcttagaggacttccaataagataccaaaccccagccatcagagccgagcacaccgggcgggagattgtggacctaatgtgtcatgccacatttactatgaggctgctatcaccagtcagagtgccaaattacaacctgatcatcatggacgaagctcacttcacagacccagcaagtatagcagctagaggatacatttcaactcgagtagagatgggtgaagcagctgggattttcatgacagccactcctccgggaagtagagacccatttcctcagagcaatgcaccaatcatggatgaggaaagagaaatccctgagcgttcgtggaactctggacatgaatgggtcacggattttaaagggaagactgtttggtttgttccaagtataaaagcgggaaatgacatagcagcttgtctcaggaaaaatggaaagaaagtgatacaactcagtaggaagacctttgactctgagtatgttaagactaggaccaatgattgggactttgtggtcacaaccgacatttcagaaatgggtgccaacttcaaggctgagagggttatagaccccagacgttgcatgaaaccagttatactaacagatggcgaagagcgggtgatcttggcaggacccatgccagtaacccactctagtgcagcgcaaagaagagggagaataggaagaaatccaaaaaatgaaaatgaccagtacatatacatgggggaacctctggaaaatgatgaagactgtgcacattggaaagaagctaaaatgctcctagacaacatcaacacacctgaaggaatcattcctagtatgttcgaaccagagcgtgaaaaggtggatgccattgatggtgaataccgcttgagaggagaagcaagaaaaacctttgtggacctaatgagaagaggggacttaccagtctggttggcctacagagtggcagctgaaggcatcaactacgcagacagaaggtggtgttttgatggagttaagaacaaccaaatactggaagaaaacgtggaagtggaaatttggacaaaagaaggggaaaggaagaaattaaaacccagatggttggatgctaggatctattctgacccactggcactaaaagaatttaaggaatttgcagctggaagaaagtccttgaccctgaacctaatcacagaaatgggaaggcttccaactttcatgactcagaaggcaagagacgcactggataacctagctgtgctgcacacggctgaggcaggtggaagggcgtacaatcatgctctcagtgaactgccggagaccctggagacactgcttttactgacactcctggctacagtcacgggaggaattttcttattcttaatgagcggaaaaggtgtggggaagatgaccctgggaatgtgctgcataatcacggctagcatcctcctatggtatgcacagatacaaccacactggatagcagcctcaataatattggagttctttctcatagttttgctcattccagaaccagaaaaacagagaacaccccaagataaccaattgacctacgttgtcatagccatcctcacagtggtggccgcaaccatggcaaacgagatgggtttcctggaaaaaaccaagaaagacctcggattgggaagcattgcaacccaggaacctgagagcaacatcctggacatagatctacgtcctgcgtcagcatggacgctgtatgccgtggctacaacatttgtcacaccaatgttaagacatagcattgaaaattcctcagtgaatgtgtccctaacagccattgctaaccaagccacagtgctaatgggtcttgggaaaggatggccattgtcaaagatggacatcggagttcccctccttgccattggatgctactcacaagtcaaccccataactctcacagcagctcttcttttattgatagcacattatgccattatagggccaggacttcaagcgaaagcaaccagagaagctcagaaaagagcagcagcaggcatcatgaaaaacccaacagtcgatggaataacagtgattgacctagatccaataccttatgatccaaaatttgaaaaacagttaggacaagtaatgctcctaattctctgcgtgactcaagtattaatgatgaggactacatgggctctgtgtgaggctctaaccttagcgaccgggcccatctccacattgtgggaaggtaatccagggaggttttggaacactaccattgcagtgtcaatggccaacatctttagagggagctacttggccggagctggacttcttttttccattatgaagaacacaacaaatacaagaagaggaactggcaacataggagagacgcttggagagaaatggaaaagccgattaaacgcactgggaaaaagtgaatttcagatctacaagaaaagtggaatccaggaagtggatagaaccttagcaaaagaaggcatcaaaagaggagaaacggaccaccacgctgtgtcgcgaggctcagcaaaactgagatggttcgtcgagagaaatatggtcacaccagaagggaaagtggtggacctcggttgcggcagagggggctggtcatactattgtgggggactaaagaatgtaagagaagtcaaaggcctgacaaaaggaggaccaggacacgaagaacccatccccatgtcaacatatgggtggaatctagtacgtctgcagagtggagttgatgttttcttcactccgccagaaaagtgtgatacattgttgtgtgacataggggagtcgtcaccaaatcccacgatagaagcaggacgaacactcagagtcctcagcttggtggaaaattggttgaacaatgacacccaattttgcataaaggttctcaacccatatatgccctcagttatagaaaaaatggaaacactgcaaaggaaatatggaggagccttggtgaggaatccactctcacgaaactccacacatgagatgtactgggtatccaatgctactgggaacatagtgtcatcagtgaacatgatttcaaggatgctgattaacagattcacaatgaaacacaagaaagccacctacgagccagatgttgacctagggagtggaactcgcaacattggaattgaaagtgagataccaaatctagacataataggaaagagaatagagaaaataaagcaagagcatgaaacatcatggcactatgaccaagaccacccatacaaaacatgggcttaccatggcagctatgaaacaaaacagactggatcagcatcatccatggtgaacggagtggtcagactgctgacaaaaccttgggacgtcgtccctatggtaacacagatggcaatgacagacacgactccatttggacaacagcgcgttttcaaagagaaagtggacacgagaacccaagaaccgaaggaaggcacaaagaaactgatgaaaatcacggcagagtggctttggaaagaactaggaaagaaaaagacacccaggatgtgtaccagagaagaattcacaagaaaagtgagaagcaatgcagccttgggagccatattcactgatgagaacaaatggaagtcggcacgcgaggctgttgaagatagtaggttctgggagctggttgacaaggaaagaaatctccatcttgaaggaaagtgtgaaacatgtgtgtacaacatgatgggaaagagagaaaagaaactaggggagttcggcaaggcaaaaggtagcagagccatatggtacatgtggcttggagcacgcttcctggagtttgaagccttgggattcttgaatgaagatcactggttctccagagagaactccctgagtggagtggaaggagaagggctgcacaagctaggctacattctaagagacgtgagcaagaaggaaggaggagcaatgtacgccgatgatacagcaggatgggacacaagaatcacactagaagacttaaaaaatgaagaaatggtaacaaaccacatggaaggagaacacaagaaactagccgaggccatatttaaattaacgtaccaaaacaaggtggtgcgtgtgcaaagaccaacaccaagaggcacagtaatggatatcatatcgagaagagaccaaagaggcagtgggcaagtcggcacctatggccttaacactttcaccaatatggaagcccaattaattagacagatggagggagaaggaattttcaaaagcattcagcacctgacagtcacagaagaaatcgccgtacaggactggttagcaagagtggggcgtgaaaggttatcaagaatggccatcagtggagatgattgtgttgtaaaacctttagatgacagatttgcaagtgctttaacagctctaaatgacatgggaaaagttaggaaagacatacaacaatgggaaccttcaagaggatggaacgattggacacaagtgcctttctgttcacaccattttcatgagttaatcatgaaagacggtcgcgtgctcgtagttccatgcagaaaccaagatgaactgatcggcagggcccgaatttcccagggagctgggtggtctttgaaggagacggcctgtttggggaagtcttacgctcaaatgtggagcctgatgtacttccacagacgtgacctcaggctggcggcaaatgctatttgctcggcagtcccgtcacattgggttccaacaagtcgaacaacctggtctatacacgccaaacatgaatggatgacgacggaagacatgctgacagtttggaacagggtgtggatccaagaaaatccatggatggaagacaaaactccagtggagtcatgggaggaagtcccatatttgggaaaaagagaagaccaatggtgcggctctttgattgggctaacaagcagggctacctgggcaaagaacatccaaactgcaataaatcaagtcagatcccttataggcaatgaggaatacacagattacatgccatccatgaagagattcagaagggaagaggaagaggcaggtgtcctgtggtag

SEQ ID NO: 6397 - RNA, 9876 nt, synthetic construct
  misc_feature 1..9876: note = derived and/or modified CDS sequence (wt) from DENV-2__KF704356__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctatttaacacaggggatggtgtgcacatgtgtaccctcatggccatgcaccttggtgaattgtgtgaagatacaatcacgtacaagtgtcctcttctcaggcagaatgaaccagaagacatagattgttggtgcaactctacgtccacatgggtaacttacgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggactatttggaaaaggaagcattgtgacctgtgctatgttcacatgcaaaaagatcatgaaaggaaaagtcgtgcaaccagaaaacttggaatacaccattgtgataacacctcactcaggggaagagcatgcagtcggaaatgatacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaagataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacgtactgttcacaggacatctcaagtgcaggctgaggatggacaaactacagctcaaaggaatgtcatactctatgtgcacaggaaagtttaaagtcgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacaggaaaagatagcccagtcaacatagaagcagaacctccattcggagacagctacatcatcataggagtagagccgggacaattgaagctcaactggtttaagaaaggaagttctatcggccaaatgtttgcgacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccaccgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaagagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaactacagaccaggctaccatacacaaacagcgggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggttctcaaaatggtgagaaaaatggaaaagtatcaattggcagtgactatcatggctatcttgtgcgtcccaaatgcagtgatattacaaaacacatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcactgcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacagaaaaggaaaagttgtgggtctttatggtaatggtgttgttacaaggagtggagcatatgtgagtgctatagcccagactgaaaaaagcattgaagacaatccagagatcgaagatgacatttttcgaaagagaaaattgaccatcatggacctccacccaggagcgggaaagacgaagagataccttccagccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataagagcaggaaatgatatagcagcttgcctgagaaaaaatggaaagaaagtgatacaactcagtaggaagacctttgattctgagtatgtcaagactagaaccaatgattgggacttcgtggttacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgttgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgttgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacattttcagagggagttacttggccggagctggacttctcttttccatcatgaagaatacaaccaacacgagaaggggaactggcaacatgggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccactttcgagccagatgtagacctcggaagcggaacccgcaacatcggaattgaaagtgagataccaaacctagacataatcgggaaaagaatagaaaaaataaaacaagagtatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccctgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccagggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6398 - RNA, 9876 nt, synthetic construct
  misc_feature 1..9876: note = derived and/or modified CDS sequence (wt) from DENV-2__KF704355__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctatttaaaacaggggatggtgtgaacatgtgtaccctcatggccatggaccttggtgaattgtgtgaagatacaatcacgtacaagtgtccttttctcaggcagaatgaaccagaagacatagattgttggtgcaactctacgtccacatgggtaacttacgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggactatttggaaaaggaagcattgtgacctgtgctatgttcacatgcaaaaagatcatgaaaggaaaagtcgtgcaaccagaaaacttggaatacaccattgtgataacacctcactcaggggaagagcatgcagtcggaaatgatacaggaaaatatggcaaggaaatcaaaataacaccacagagttccatcacagaagcagagttgacaggctatggcactgtcacgatggagtgctctccgagaacgggcctcgacttcaatgagatggtgttgctgcaaatggaagataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacgtactgttcacaggacatctcaagtgcaggctgaggatggacaaactacagctcaaaggaatgtcatactctatgtgcacaggaaagtttaaagtcgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacaggaaaagatagcccagtcaacatagaagcagaacctccattcggagacagctacatcatcataggagtagagccgggacaattgaagctcaactggtttaagaaaggaagttctatcggccaaatgtttgggacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcacaggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccactgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaactacagaccaggctaccatacacaaacagcgggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggttcttaaaatggtgagaaaaatggaaaagtatcaattggcagtgactatcatggccatcttgtgcgtcccaaatgctgtgatattacaaaacgcatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttctctcctaaagaatgacattcccatgacaggaccattggtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcacggcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacagaaaaggaaaagttgtgggtctttatggtaatggtgttgttacaaggagtggagcatatgtgagtgctatagcccagactgaaaaaagcattgaagacaatccagagatcgaagatgacatttttcgaaagagaaaattgaccatcatggacctccacccaggagcgggaaagacgaagagataccttccagccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataagagcaggaaatgatatagcagcttgcctgagaaaaaatggaaagaaagtgatacaactcagtaggaagacctttgattctgagtatgtcaagactagaaccaatgattgggacttcgtggttacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgttgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcatcacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgttgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacattttcagagggagttacttggccggagctggacttctcttttccatcatgaagaatacaaccaacacgagaaggggaactggcaacataggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactttcacgaaactccacacatgagatgtactgggtatccaatgcctccgggaacatagtgtcatcagtgaacatgatttcaaggatgttgatcaacagattcacaatgagacacaagaaagccacttacgagccagatgtagacctcggaagcggaacccgcaacatcggaattgaaagtgagataccaaacctagacataatcgggaaaagaatagaaaaaataaaacaagagtatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccctgagtggagtggaaggagaagggctgcacaagctaggatacatcttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccaaggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6399 - RNA, 9876 nt, synthetic construct
  misc_feature 1..9876: note = derived and/or modified CDS sequence (wt) from DENV-2__KF704354__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctatttaaaacagaggatggtgtgaacatgtgtaccctcatggccatggaccttggtgaattgtgtgaagatacaatcacgtacaagtgtccttttctcaggcagaatgaaccagaagacatagattgttggtgcaactctacgtccacatgggtaacttacgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggattttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggactatttggaaaaggaggcattgtgacctgtgctatgttcacatgcaaaaagatcatgaaaggaaaagtcgtgcaaccagaaaacttggaatacaccattgtgataacacctcactcaggggaagagcatgcagtcggaaatgatacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaaaataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacgtactgttcacaggacatctcaagtgcaggctgaggatggacaaactacagctcaaaggaatgtcatactctatgtgcacaggaaagtttaaagtcgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacaggaaaagatagcccagtcaacatagaagcagaacctccattcggagacagctacatcatcataggagtagagccgggacaattgaagctcaactggtttaagaaaggaagttctatcggccaaatgtttgcgacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaaatgtggcagtggaattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccaccgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaagagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagtaatggagtgctagaaagtgagatgataattccaaagaatttcgctggaccagtgtcacaacacaactacagaccaggctaccatacacaaacagcgggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtcctcaaaatggtgagaaaaatggaaaagtatcaattggcagtgactatcatggctatcttgtgcgtcccaaatgcagtgatattacaaaacacatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcactgcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgtggcgctgttctaatgcataaaggaaagaggattgaaccatcatgggcggacgttaagaaagacctaatatcatatggaggaggctggaggctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagcattgaagacaatccagagatcgaagatgacatttttcgaaagagaaaattgaccatcatggacctccacccaggagcgggaaagacgaagagataccttccagccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataaaagcaggaaatgatatagcagcttgcctgagaaaaaatggaaagaaagtgatacaactcagtaggaagacctttgattctgagtatgtcaagactagaaccaatgattgggacttcgtggttacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgttgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggatggggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgttgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaatacaaccaacacgagaaggggaactggcaacatgggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagagaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccactttcgagccagatgtagacctcggaagcggaacccgcaacatcggaattgaaagtgagataccaaacctagacataatcgggaaaagaatagaaaaaataaaacaagagtatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtaacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccctgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccagggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6400 - RNA, 9876 nt, synthetic construct
  misc_feature 1..9876: note = derived and/or modified CDS sequence (wt) from DENV-2__KF704357__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctatttaaaacaggggatggtgtgaacatgtgtaccctcatggccatggaccttggtgaattgtgtgaagatacaatcacgtacaagtgtcctcttctcaggcagaatgaaccagaagacatagattgttggtgcaactctacgtccacatgggtaacttacgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggactatttggaaaaggaagcattgtgacctgtgctatgttcacatgcaaaaagatcatgaaaggaaaagtcgtgcaaccagaaaacttggaatacaccattgtgataacacctcactcaggggaagagcatgcagtcggaaatgatacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaagataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacgtactgttcacaggacatctcaagtgcaggctgaggatggacaaactacagctcaaaggaatgtcatactctatgtgcacaggaaagtttaaagtcgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacaggaaaagatagcccagtcaacatagaagcagaacctccattcggagacagctacatcatcataggagtagagccgggacaattgaagctcaactggtttaagaaaggaagttctatcggccaaatgtttgcgacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcataggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccaccgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaagagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaactacagaccaggctaccatacacaaacagcgggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggtcctcaaaatggtgagaaaaatggaaaagtatcaattggcagtgactatcatggctatcttgtgcgtcccaaatgcagtgatattacaaaacacatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcactgcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgtggcgctgttctaatgcataaaggaaagaggattgaaccatcatgggcggacgttaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacagaaaaggaaaagttgtgggtctttatggtaatggtgttgttacaaggagtggagcatatgtgagtgctatagcccagactgaaaaaagcattgaagacaatccagagatcgaagatgacatttttcgaaagagaaaattgaccatcatggacctccacccaggagcgggaaagacgaagagataccttccagccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataagagcaggaaatgatatagcagcttgcctgagaaaaaatggaaagaaagtgatacaactcagtaggaagacctttgattctgagtatgtcaagactagaaccaatgattgggacttcgtggttacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgttgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcatcacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgttgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacattttcagagggagttacttggccggagctggacttctcttttccatcatgaagaatacaaccaacacgagaaggggaactggcaacatgggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccactttcgagccagatgtagacctcggaagcggaacccgcaacatcggaattgaaagtgagataccaaacctagacataatcgggaaaagaatagaaaaaataaaacaagagtatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtaacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccctgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacttaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccagggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6401 - RNA, 9876 nt, synthetic construct
  misc_feature 1..9876: note = derived and/or modified CDS sequence (wt) from DENV-2__KF704358__SS-prME
  source 1..9876: mol_type = other RNA
actgcaggcatgatcattatgctgattccaacagtgatggcgttccatttaaccacacgtaacggagaaccacacatgatcgtcagtagacaagagaaagggaaaagtcttctatttaacacaggggatggtgtgcacatgtgtaccctcatggccatgcaccttggtgaattgtgtgaagatacaatcacgtacaagtgtcctcttctcaggcagaatgaaccagaagacatagattgttggtgcaactctacgtccacatgggtaacttacgggacgtgtaccaccacaggagaacacagaagagaaaaaagatcagtggcactcgttccacatgtgggaatgggactggagacacgaactgaaacatggatgtcatcagaaggggcctggaaacatgcccagagaattgaaacttggatcttgagacatccaggctttaccataatggcagcaatcctggcatacaccataggaacgacacatttccaaagagccctgattttcatcttactgacagctgtcgctccttcaatgacaatgcgttgcataggaatatcaaatagagactttgtagaaggggtttcaggaggaagctgggttgacatagtcttagaacatggaagctgtgtgacgacgatggcaaaaaacaaaccaacattggatcttgaactgataaaaacagaagccaaacaacctgccactctaaggaagtactgtatagaggcaaagctgaccaacacaacaacagaatctcgctgcccaacacaaggagaacccagcctaaatgaagagcaggacaaaaggttcgtctgcaaacactccatggtggacagaggatggggaaatggatgtggactatttggaaaaggaagcattgtgacctgtgctatgttcacatgcaaaaagatcatgaaaggaaaagtcgtgcaaccagaaaacttggaatacaccattgtgataacacctcactcaggggaagagcatgcagtcggaaatgatacaggaaaacatggcaaggaaatcaaaataacaccacagagttccatcacagaagcagagttgacaggctatggcactgtcacgatggagtgctctccgagaacgggcctcgacttcaatgagatggtgttgctgcaaatggaagataaagcttggctggtgcacaggcaatggttcctagacctgccgttgccatggctgcccggagcggacacacaaggatcaaattggatacagaaagagacattggtcactttcaaaaatccccatgcgaagaaacaggatgttgttgttttgggatcccaagaaggggccatgcacacagcactcacaggggccacagaaatccagatgtcatcaggaaacgtactgttcacaggacatctcaagtgcaggctgaggatggacaaactacagctcaaaggaatgtcatactctatgtgcacaggaaagtttaaagtcgtgaaggaaatagcagaaacacaacatggaacaatagttatcagagtacaatatgaaggggacggttctccatgtaagatcccttttgagataatggatttggaaaaaagacatgttttaggtcgcctgattacagtcaacccaatcgtaacaggaaaagatagcccagtcaacatagaagcagaacctccattcggagacagctacatcatcataggagtagagccgggacaattgaagctcaactggtttaagaaaggaagttctatcggccaaatgtttgcgacaacaatgaggggagcgaagagaatggccattttaggtgacacagcttgggattttggatccctgggaggagtgtttacatctataggaaaggctctccaccaagttttcggagcaatctatggggctgccttcagtggggtctcatggactatgaaaatcctcacaggagtcattatcacatggataggaatgaattcacgcagcacctcactgtctgtgtcactagtattggtgggagtcgtgacgctgtatttgggagttatggtgcaggccgatagtggttgcgttgtgagctggaaaaacaaagaactgaaatgtggcagtgggattttcatcacagacaacgtgcacacatggacagaacaatacaagttccaaccagaatccccttcaaaactagcttcagctatccagaaagctcatgaagagggcatttgtggaatccgctcagtaacaagactggaaaatctgatgtggaaacaaataacaccagaattgaatcacattctatcagaaaatgaggtgaagttgactattatgacaggagacatcaaaggaatcatgcaggcaggaaaacgatctctgcggccccagcccaccgagctgaagtattcatggaaaacatggggcaaagcgaaaatgctctctacagagtctcataaccagacctttctcattgatggccccgaaacagcagaatgccccaacacaaacagagcttggaattcgctggaagttgaagactatggctttggagtattcaccaccaatatatggctaaagttgagagaaaagcaggatgtattctgcgactcaaaactcatgtcagcggccataaaagacaacagagccgtccatgccgatatgggttattggatagaaagtgcactcaatgacacatggaagatagagaaagcctctttcatcgaagttaaaagctgccactggccaaagtcacacaccctctggagcaatggagtgctagaaagtgagatgataattccaaagaatttcgctggaccagtgtcacaacacaactacagaccaggctaccatacacaaacagcgggaccatggcatctaggtaagcttgagatggactttgatttctgcgaaggaaccacagtggtggtgactgaggactgtggaaatagaggaccctctttaagaacaactactgcctctggaaaactcataacagaatggtgctgccgatcttgcacattaccaccgctaagatacagaggtgaggacggatgctggtacgggatggaaatcagaccattgaaagagaaagaagagaatttggtcaactccttggtcacagccggacatgggcagattgacaacttttcactaggagtcttgggaatggcattgttcctggaagaaatgctcaggacccgagtaggaacgaaacatgcaatactactagttgcagtttcttttgtgacattgatcacagggaacatgtcctttagagacctgggaagagtgatggttatggtgggcgctactatgacggatgacataggtatgggcgtgacttatcttgccctactagcagccttcaaagtcagaccaacttttgcagctggactactcttgagaaagttgacctccaaggaattgatgatgactaccataggaatcgtactcctctcccagagcaccataccagagaccattcttgaactgactgatgcgttagccttgggcatgatggttctcaaaatggtgagaaaaatggaaaagtatcaattggcagtgactatcatggctatcttgtgcgtcccaaatgcagtgatattacaaaacacatggaaagtgagttgcacaatattggcagtggtgtccgtttccccactgttcttaacatcctcacagcagaaagcggattggataccattagcattgacgatcaagggtctcaatccaacagctatttttctaacaaccctttcaagaaccaacaagaaaaggagctggccactaaatgaggctatcatggcagtcgggatggtgagcattttggccagttcactcctaaagaatgacattcccatgacaggaccattagtggctggagggctcctcactgtgtgctacgtgctcactggacgatcggccgatttggaactggagagagccgccgatgtcaaatgggaagatcaggcagagatatcaggaagcagtccaatcctgtcaataacaatatcagaagatggtagcatgtcgataaaaaacgaagaggaagaacaaacactgaccatactcattagaacaggattgctggtgatctcaggactttttcctgtatcaataccaatcactgcagcagcatggtacctgtgggaagtgaagaaacaacgggctggagtattgtgggatgtcccttcacccccacccgtgggaaaggctgaactggaagatggagcctatagaatcaagcaaaaagggattcttggatattcccagatcggagccggagtttacaaagaaggaacattccatacaatgtggcatgtcacacgtggcgctgttctaatgcataaaggaaagaggattgaaccatcatgggcggacgtcaagaaagacctaatatcatatggaggaggctggaagctagaaggagaatggaaggaaggagaagaagtccaggtcttggcattggagcctggaaaaaatccaagagccgtccaaacaaaacctggtcttttcaaaaccaacgccggaaccataggtgccgtatctctggacttttctcctggaacctcaggatctccaatcatcgacaaaaaaggaaaagttgtgggtctttatggtaatggtgttgttacaaggagtggagcatatgtgagtgctatagcccagactgaaaaaagcattgaagacaatccagagatcgaagatgacatttttcgaaagagaaaattgaccatcatggacctccacccaggagcgggaaagacgaagagataccttccagccatagtcagagaggctataaaacggggcctgaggacattaatcctggcccccactagagtcgtggcagctgaaatggaggaagccctaagaggacttccaataagataccaaaccccagccatcagagctgagcacaccgggcgggagattgtggacctaatgtgtcatgccacattcactatgaggctgctatcaccagttagagtgccaaattacaacctgatcatcatggacgaagcccatttcacagacccagcaagtatagcggctagaggatacatctcaactcgagtagagatgggtgaggcagctgggattttcatgacagccactcctccgggaagcagagacccattccctcagagcaatgcaccaatcatggatgaagaaagagaaatccctgaacgttcgtggagttctggacatgagtgggtcacggattttaaagggaagactgtttggttcgttccaagtataagagcaggaaatgatatagcagcttgcctgagaaaaaatggaaagaaagtgatacaactcagtaggaagacctttgattctgagtatgtcaagactagaaccaatgattgggacttcgtggttacaactgacatttcagaaatgggtgccaacttcaaggctgagagggttatagaccccagacgctgcatgaaaccagttatactaacagatggtgaagagcgggtgatcctggcaggacctatgccagtgacccactctagtgcagcacaaagaagagggagaataggaagaaatccaaaaaatgaaaatgaccagtacatatacatgggggaacctctggaaaatgatgaagactgtgcacactggaaagaagctaaaatgctcctagataacatcaacacacctgaaggaatcattcctagcatgttcgaaccagagcgtgaaaaggtggatgccattgatggtgaataccgcttgagaggagaagcaaggaaaacctttgtggacctaatgagaagaggagacctaccagtctggttggcctacagagtggcagctgaaggcatcaactacgcagacagaaggtggtgttttgatggaattaagaacaaccaaatcttggaagaaaatgtggaggtggaaatctggacaaaagaaggggaaaggaagaaattaaaacccagatggttggatgccaggatctactctgacccactggcgctaaaggaattcaaggagtttgcagctggaagaaagtccctgaccctgaacctaatcacagaaatgggtaggcttccaactttcatgactcagaaggcaagagacgcactggacaacttagcagtgttgcacacggctgaagcaggtggaagggcgtacaatcatgctctcagtgaactgccggagaccctggagacattgcttttactgacacttctggctacagtcacaggaggaatctttttattcttgatgagcggaaggggtatagggaagatgaccctgggaatgtgctgcataatcacggctagtattctcctatggtacgcacaaatacagccacactggatagcagcttcaataatactggagttttttctcatagttttgcttattccagaaccagaaaagcagagaacaccccaagataaccaattgacctacgttgtcatagccatcctcacagtggtggccgcaaccatggcaaacgagatgggtttcctggaaaaaacgaagaaagatctcggattgggaagcattacaacccagcaacccgagagcaacatcctggacatagatctacgtcccgcatcagcatggacgctgtatgctgtggccacaacatttgtcacaccaatgttgagacacagcattgaaaattcctcagtgaacgtgtccctaacagctattgccaaccaagccacagtgttaatgggtcttgggaaaggatggccattgtcaaagatggacatcggagttccccttctcgccattggatgctactcacaagtcaaccccataactctcacagcagctcttttcttactggtagcacattatgccatcatagggccaggactccaagcaaaagcaaccagagaagctcagaaaagagcagcagcgggcatcatgaaaaacccaactgttgatggaataacagtgattgacctagatccaataccctatgatccaaagtttgaaaagcagttgggacaagtaatgctcctagtcctctgcgtgactcaagtgttgatgatgaggactacatgggctctgtgtgaggctttaaccttagcgaccgggcctatctccacattgtgggaaggaaatccagggaggttttggaacactaccattgcagtgtcaatggctaacatttttagagggagttacttggccggagctggacttctcttttccatcatgaagaatacaaccaacacgagaaggggaactggcaacatgggagagacgcttggagagaaatggaaaagccgattgaacgcattggggaaaagtgaattccagatctacaagaaaagtggaatccaggaagtggatagaaccttagcaaaagaaggcattaaaagaggagaaacggaccatcacgctgtgtcgcgaggctcagcaaaactgagatggttcgtcgagagaaatatggtcacaccagaagggaaagtagtggacctcggttgcggcagaggaggctggtcatactattgtgggggactaaagaatgtaagagaagtcaaaggcctaacaaaaggaggaccaggacatgaagaacccatccccatgtcaacatatgggtggaatctagtacgtcttcaaagtggagttgacgttttcttcactccgccagaaaagtgtgacacattgttgtgtgacataggggagtcgtcaccaaatcccacggtagaagcaggacgaacactcagagtccttaacttagtggaaaattggttgaacaacaacacccaattttgcataaaggttctcaacccatacatgccctcagtcatagaaaaaatggaagcactacaaaggaaatatggaggagccttagtgaggaatccactctcacgaaactccacacatgagatgtactgggtatccaatgcctccgggaacatagtgtcatcagtgaacatgatttcaaggatgttgatcaacagattcacaatgagacacaagaaagccactttcgagccagatgtagacctcggaagcggaacccgcaacatcggaattgaaagtgagataccaaacctagacataatcgggaaaagaatagaaaaaataaaacaagagtatgaaacatcatggcactatgaccaagaccacccatacaaaacgtgggcttaccatggcagctatgaaacaaaacaaactggatcagcatcatccatggtgaacggagtggtcagactgctgacaaaaccttgggacgtcgtccccatggtgacacagatggcaatgacagacacgactccatttggacaacagcgcgtttttaaagaaaaagtggacacgagaacccaagaaccgaaagaaggcacaaagaaactaatgaaaatcacggcagagtggctttggaaagaactagggaagaaaaagacacctaggatgtgcactagagaagaattcacaagaaaggtgagaagcaatgcagccttgggggccatattcactgatgagaacaagtggaagtcggcacgtgaggctgttgaagatagtaggttttgggagctggttgacaaggaaaggaatctccatcttgaaggaaagtgtgaaacatgtgtgtacaacatgatgggaaaaagagagaagaagctaggggagttcggcaaggcaaaaggcagcagagccatatggtacatgtggcttggagcacgcttcttagagtttgaagccctaggattcttgaatgaagatcactggttctccagagagaactccctgagtggagtggaaggagaagggctgcacaagctaggttacattttaagagacgtgagcaagaaagagggaggagcaatgtatgccgatgacaccgcaggatgggacacaagaatcacactagaagacctaaaaaatgaagaaatggtaacaaaccacatggaaggagaacacaagaaactagccgaggccattttcaaattaacgtaccaaaacaaggtggtgcgtgtgcaaagaccaacaccaagaggcacagtaatggatatcatatcgagaagagaccaaagaggtagtggacaagttggtacctatggactcaatactttcaccaatatggaagcccaactaatcagacagatggagggagaaggagtcttcaaaaacattcagcacctgacagtcacagaagaaatcgccgtgcaaaactggttagcaagagtagggcgcgaaaggttatcaagaatggccatcagtggagatgattgtgttgtgaaacctttagatgacaggttcgcaagcgctttaacagctctaaatgacatgggaaaggttaggaaagacatacaacaatgggaaccttcaagaggatggaacgattggacacaagtgcccttctgttcacaccatttccatgagttaatcatgaaagacggccgcgtacttgtagttccatgcagaaaccaagatgaactgattggtagagcccgaatttcccagggagctgggtggtctttgcgagagacggcctgtttggggaagtcctacgcccaaatgtggagcttgatgtacttccacagacgtgacctcaggctggcggctaatgctatttgctcggcagtcccatcacattgggttccaacaagtagaacaacctggtccatacacgccaaacatgaatggatgacaacggaagacatgctgacagtctggaacagggtgtggattcaagaaaacccatggatggaagacaaaactccagtggaatcatgggaggaaatcccatacttggggaaaagagaagaccaatggtgcggctcattgattgggctaacaagcagggccacctgggcaaagaacatccaaacagcaataaatcaagttagatcccttataggcaatgaggaatacacagattacatgccatccatgaaaagattcagaagagaagaggaagaggcaggagtcctgtggtag

SEQ ID NO: 6402 - RNA, 9876 nt, synthetic construct
  misc_feature 1..9876: note = derived and/or modified CDS sequence (wt) from DENV-2__KF041232__SS-prME
  source 1..9876: mol_type = other RNA
accgcaggcgtgatcatcatgctgattccaacagcgatggcgttccatttaaccacacgcaacggagaaccacacatgatcgtcagcaaacaggagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaacgccacgtccacatgggtaacttatgggacatgcactgccacaggagaacacagaagggaaaaaagatcagtggcacttgtcccacatgtgggaatgggattggagacacgaactgaaacgtggatgtcatcagaaggggcctggaaacacgcccagaggattgaaacctggatcttgagacatccaggttttaccataatggcagcaatcttggcatacaccataggaacgacatatttccaaagagtcctgatattcatcttactgacagctgtcgctccttcaatgacaatgcgctgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcctggctggtgcacaggcaatggttcttagacctgccgttaccatggctgcccggagcggacatacaaggatcaaattggatacagaaggagacgttggtcactttcaaaaacccccatgcgaagaaacaggatgttgttgttttaggatcccaagaaggggctatgcatacagcactcacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgaaacaacaatgagaggagcgaagagaatggccattttaggtgacacagcctgggattttggatccctgggaggagtgttcacatctataggaaaggccctccaccaagtttttggagctatctatggggctgccttcagtggggtttcatggactatgaaaatcctcataggagttgtcatcacatggataggaatgaattcacgtagcacctcactgtctgtgtcactagtattagtgggagtcgtgacattgtacttgggagctatggtgcaggctgatagtggttgtgttgtgagttggaaaaacaaagaactgaaatgtggcagtgggattttcatcacagacaatgtacacacatggacagaacaatacaaattccaaccagaatccccctcaaagctggcttcagctatccagaaagctcatgaagaaggcatttgtggaatccgctcagtaacaagattggagaatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatgggcagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagtagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggacgttccttcacccccacctgtgggaaaggccgaactggaagatggagcctacagaatcaagcagaaagggattcttggatactcccagatcggagctggagtttacaaagaaggaacattccacacaatgtggcacgtcacacgtggcgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacactggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcggaaaaaaagattgaccattatggacctccacccaggagcgggaaagacgaaaagataccttccagcaatagttagagaggccataaaacgaggcttaagaacattaatcctggcccccactagagttgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcccccgggaagcagagacccatttcctcaaagcaatgcaccaatcatggatgaagagagggaaatccctgaacgttcgtggaactctggacatgagtgggttacagatttcaaagggaagactgtttggtttgttccgagcataaaagcaggtaatgatatagcagcttgcctgagaaaaaatggaaagaaagtgatacaactcagtaggaagacctttgattctgaatacattaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtaacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaaccatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggactgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaagatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtaagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgcgttgtgaaacccttagatgacaggtttgcaaacgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacattgggttccgacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgtggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 6403 - RNA, 9876 nt, synthetic construct
  misc_feature 1..9876: note = derived and/or modified CDS sequence (wt) from DENV-2__KF041233__SS-prME
  source 1..9876: mol_type = other RNA
accgcaggcgtgatcatcatgctgattccaacagcgatggcgttccatttaaccacacgcaacggagaaccacacatgatcgtcagcaaacaagagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacgtggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgcatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcttagacctgccgttaccatggttgcccggagcggacatacaaggatcaaattggatacagaaggagacgttggtcactttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcatcacagacaatgtacacacatggacagaacaatacaaattccaaccagaatccccctcaaagctggctgcagctatccagaaagctcatgaagaaggcatttgtggaatccgctcagtaacaagactggagaatctaatgtggaaacaaataacaccagaactgaatcacattctatcagaaaatgaggtaaagttatctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaattagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactgattgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgaccatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagcagtccaattctgtcaataacaatatcggaagatggcagcatgtcgataaaaaatgaagaggaagaacaaacattgaccatactcattagaacaggattgctggtgatatcaggacttttccccgtatcaataccaatcacggcagcagcatggtacctgtgggaagtgaagaaacaacgggctggagtattgtgggacgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcggaaaaaaaaattgaccattatggacctccacccaggagcgggaaagacgaaaagataccttccagcaatagttagagaggccataaaacgaggcttaagaacattaatcctggcccccactagagtcgtggcagctgaaatggaggaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggagaagcagctgggattttcatgacagccactcccccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcgggcaatgatatagcagcttgcctgagaaaaaatggaaagaaagtgatacaactcagtaggaagacctttgattctgaatacatcaagactaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagaaactctggagacattgcttttgctgacacttttggccacagtcacgggcggaatctttctattcttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaaaatggatattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtatcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtaaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacagcctgtctggggaagtcttacgcccaaatgtggagcctgatgtacttccacagacgtgacctcaggctggcagcaaacgctatttgctcggcagttccatcacattgggttccgacaagtcgaacaacctggtccatacacgccagacatgaatggatgacaacagaagacatgctgacagtctggaacagggtgtggattcaagaaaacccatggatggaagacaaaactctagtggaatcatgggaggaaatcccatacttggggaaaagagaagaccaatggtgcggctcattgatagggttaacaagcagggccacctgggcaaggaacatccaaacagcaataaaccaagtcagatccttgataggcagtgaggaatacacagactacatgccatccatgaaaagattcagaagagaagaggaagaggcaggggtcttgtggtag

SEQ ID NO: 6404 - RNA, 9876 nt, synthetic construct
  misc_feature 1..9876: note = derived and/or modified CDS sequence (wt) from DENV-2__KF041234__SS-prME
  source 1..9876: mol_type = other RNA
accgcaggcgtgatcatcatgctgattccaacagcgatggcgttccatttaaccacacgcaacggagaaccacacatgatcgtcagcaaacaggagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaacgccacgtccacatgggtaacttatgggacatgcactgccacaggagaacacagaagggaaaaaagatcagtggcacttgtcccacatgtgggaatgggattggagacacgaactgaaacgtggatgtcatcagaaggggcctggaaacacgcccagaggattgaaacctggatcttgagacatccaggttttaccataatggcagcaatcttggcatacaccataggaacgacatatttccaaagagtcctgatattcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcttagacctgccgttaccatggctgcccggagcggacatacaaggatcaaattggatacagaaggagacgttggtcactttcaaaaacccccatgcgaagaaacaggatgttgttgttttaggatcccaagaaggggctatgcatacagcactcacaggggccacggaaatccagatgtcatcaggaaacctactgttcacaggacatctcaagtgcaggctgagaatggataaattacagctcaaaggaatgtcatactctatgtgtacaggaaagtttaaagttataaaggaaatagcagaaacacaacatggaacaatagttgtcagagtacaatatgaaggggatggttctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgaaacaacaatgagaggagcgaagagaatggccattttaggtgacacagcctgggattttggatccctgggaggagtgttcacatctataggaaaggccctccaccaagtttttggagctatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcatcacagacaatgtacacacatggacagaacaatacaaattccaaccagaatccccctcaaagctggcttcagctatccagaaagctcatgaagaaggcatttgtggaatccgctcagtaacaagattggagaatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatgggcagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagtagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggacgttccttcacccccacctgtgggaaaggccgaactggaagatggagcctacagaatcaagcagaaagggattcttggatactcccagatcggagctggagtttacaaagaaggaacattccacacaatgtggcacgtcacacgtggcgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacactggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcggaaaaaaagattgaccattatggacctccacccaggagcgggaaagacgaaaagataccttccagcaatagttagagaggccataaaacgaggcttaagaacattaatcctggcccccactagagttgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcccccgggaagcagagacccatttcctcaaagcaatgcaccaatcatggatgaagagagggaaatccctgaacgttcgtggaactctggacatgagtgggttacagatttcaaagggaagactgtttggtttgttccgagcataaaagcaggtaatgatatagcagcttgcctgagaaaaaatggaaagaaagtgatacaactcagtaggaagacctttgattctgaatacattaagaccaggaccaatgattgggactttgtggtcacgactgacatatcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaaccatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggactgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaagatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaagggatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtaagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgcgttgtgaaacccttagatgacaggtttgcaaacgctttaacagctctaaatgacatgggaaaggttaggaaagacatacaacaatgggaaccttcaagaggatggagcgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacattgggttccgacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgtggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 6405 - RNA, 9876 nt, synthetic construct
  misc_feature 1..9876: note = derived and/or modified CDS sequence (wt) from DENV-2__KF041235__SS-prME
  source 1..9876: mol_type = other RNA
accgcaggcgtgatcatcatgctgattccaacagcgatggcgttccatttaaccacacgcaacggagaaccacacatgatcgtcagcaaacaagagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacgtggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcttagacctgccgttaccatggttgcccggagcggacatacaaggatcaaattggatacagaaggagacgttggtcactttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcatcacagataatgtacacacatggacagaacaatacaaattccaaccagaatccccctcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgttggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattcttaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagcagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggccggagtattgtgggacgttccttcacccccacctgtgggaaaggctgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcatatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagcaactcccccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgagaaaaaatggaaagaaagtgatacaactcagtaggaagacctttgattctgaatacattaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaaaatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatttgctcggcagttccatcacattgggttccgacaagtcgaacaacctggtccatacacgccagacatgaatggatgacaacagaagacatgctgacagtctggaacagggtgtggattcaagaaaacccatggatggaagacaaaactccagtggaatcgtgggaggaaatcccatacttggggaaaagagaagaccaatggtgcggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 6406 - RNA, 9876 nt, synthetic construct
  misc_feature 1..9876: note = derived and/or modified CDS sequence (wt) from DENV-2__KF041237__SS-prME
  source 1..9876: mol_type = other RNA
accgcaggcgtgatcatcatgctgattccaacagcgatggcgttccatttaaccacacgcaacggagaaccacacatgatcgtcagcaaacaagagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacgtggatgtcatcagaaggggcctggaaacacgcccagagaattgaaacctggatcttgagacatccaggttttaccataatggcagcaatcttggcatacaccataggaacgacatatttccaaagagtcctgatcttcatcttactgacagctgtcgctccttcaatgacaatgcgttgtattggaatatcaaatagagactttgtggaaggggtctcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaaaaaaaacatggaagggaaaattgtgcaaccagaaaacctggaatacaccattgtggtaacacctcattcaggggaagagaatgcagttggaaatgacacaggaaaacatggcaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcttagacctgccgttaccatggttgcccggagcggacatacaaggatcaaattggatacagaaggagacgttggtcactttcaaaaatccccatgcgaagaaacaggatgttgttgttttaggatcccaagaaggggctatgcatacagcacttacaggggccacggaaatccagatgtcatcaggaaacctactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagagtacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcatcacagacaatgtgcacacatggacagaacaatacaaattccaaccagaatccccctcaaagctggcttcagctatccagaaagctcatgaagaaggcatttgtggaatccgctcagtaacaagactggagaatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacataattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactaagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagagatgctcaggacccgagtaggaacaaaacatgcagtattactggttgcagtttctttcatgacattgatcacagggaacatgtctttccgagacctagggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagccattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagcagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggacgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagatgatatctttcggaaaaaaagattgaccattatggacctccacccaggagcgggaaagacgaaaagataccttccagcaatagttagagaggccataaaacgaggcttaagaacattaatcctggcccccactagagtcgtggcagctgaaatggaagaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagagatgggtgaagcagctgggattttcatgacagccactcccccgggaagcagagacccatttcctcaaagcaatgcaccaatcatggatgaagaaagggaaatccctgaacgttcgtggaactctggacatgagtgggttacagatttcaaagggaagactgtttggtttgttccgagtataaaagcaggtaatgatatagcagcttgcctgagaaaaaatggaaagaaagtgatacaactcagtaggaagacctttgattctgaatacatcaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctggaagaaaatccctgaccctgaatttaatcacagaaatgggtaggcttccaacttttatgactcagaaagcaaggaacgcactggacaacttagcagtcctgcatacggctgaagcaggcggaagggcgtacaatcatgctctcagtgaactgccagagactctggagacattgcttttgctgacacttttggccacagtcacgggcggaatctttttattcttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggattgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaaaatggacattggagttccccttctcgccatcgggtgctattcacaagtcaaccccataaccctcacagcagcccttcttttattggtagcacattacgctatcatagggccaggactccaagcgaaagcaaccagagaagcgcagaaaagagcagcagcaggcatcatgaaaaacccaactgtggatggaataacagtgattgacctagatccaataccctatgacccaaaatttgagaagcagctgggacaagtaatgctcctagtcctctgcgtgactcaagtactgatgatgaggactacatgggctttgtgtgaggctctaaccttagcgaccgggcccatctccacattgtgggaaggaaatccagggagattctggaacacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgattgaattcattggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgtcttctttactccaccagaaaaatgtgacacattgttgtgtgatataggggagtcgtcaccaaatcccacggttgaagctggacgaacactcagagtcctaaacttggtagaaaattggctgaacaacaacacccaattttgcataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgagccagatgttgacctcggaagcggaacccgcaacatcggaatcgaaagtgagacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaacgctatctgctcggcagttccatcacattgggttccgacaagtcgaacaacctggtccatacacgccggacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaggaacatccaaacagcaataaaccaagttagatccttaataggcagtgaggaatacacagactacatgccatccatgaaaagattcagaagagaagaggaagaggcaggggtcttgtggtag

SEQ ID NO: 6407 - RNA, 9876 nt, synthetic construct
  misc_feature 1..9876: note = derived and/or modified CDS sequence (wt) from DENV-2__KM217156__SS-prME
  source 1..9876: mol_type = other RNA
accgcaggcgtgatcatcatgctgattccaacagcgatggcgttccatttaaccacacgcaacggagaaccacacatgatcgtcagcaaacaggagaaagggaaaagtctcttgtttaaaacagaggatggtgtgaacatgtgcaccctcatggccatggaccttggtgaactgtgtgaagacacaatcacttataactgtcctcttctcaggcagaatgaaccagaagatatagattgttggtgtaacgccacgtccacatgggtaacttatgggacatgcactgccacaggagaacacagaagggaaaaaagatcagtggcacttgtcccacatgtgggaatgggattggagacacgaactgaaacgtggatgtcatcagaaggggcctggaaacacgcccagaggattgaaacctggatcttgagacatccaggttttaccataatggcagcaatcttggcatacaccataggaacgacatatttccaaagagtcctgatattcatcttactgacagctgtcgctccttcaatgacaatgcgttgtattggaatatcaaatagagacttcgtggaaggggtttcaggaggaagctgggttgacatagtcttagaacatggaagctgtgtgacaacgatggcaaaaaacaaaccaacattggactttgaactgataaaaacagaagccaagcaacctgccactctaaggaagtactgtatagaggcaaagctgaccaacacaacaacagcatctcgatgcccaacacaaggggaacccagcctaaatgaagaacaggacaaaaggtttgtctgcaaacattccatggtagacagaggatggggaaatggatgtggattatttggaaagggaggcattgtgacctgtgctatgttcacatgcaagaaaaacatggaagggaaaattgtgcaaccagaaaacctggaatacaccattgtggtaacacctcattcaggggaagagaatgcagttggaaacgacacaggaaaacatgggaaggaaatcaaagtgacaccacagagttccattacagaagcagaactgacaggctacggcactgtcacgatggagtgctctccaagaacgggcctcgacttcaatgagatggtgttgctgcaaatggaaaacaaggcttggctggtgcacaggcaatggttcctagacctgccgttaccatggttgcccggagcggacatacaaggatcaaattggatacagaaggagacgttggtcaccttcaaaaatccccatgcgaagaaacaggatgttgttgttttaggatcccaagaaggggctatgcatacagcacttacaggggccacggaaatccagatgtcatcaggaaacccactgttcacaggacatctcaagtgcaggctgagaatggataaattacagctcaaaggaatgtcatactctatgtgtacaggaaagtttaaagttgtaaaggaaatagcagaaacacaacatggaacaatagttgtcagaatacaatatgaaggggatggctctccatgtaaaatcccttttgagataatggatttggaaaaaagacatgtcttaggtcgcctgattacagtcaacccaatcgtcacagaaaaagacagtccagtcaacatagaagcagaacccccattcggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtgttcacatctataggaaaggccctccaccaagtttttggagcaatctatggggctgccttcagtggggtttcatggactatgaaaatcctcataggagttgtcatcacatggataggaatgaattcacgtagcacctcactgtctgtgtcactagtattagtgggagtcgtgacattgtacttgggagttatggtgcaggctgatagtggttgtgttgtgagttggaaaaacaaagaactgaaatgtggcagtgggattttcttcacagacaatgtacacacatggacagaacaatacaaattccaaccagaatccccctcaaagctggcttcagctatccagaaagctcatgaagaaggcatttgtggaatccgctcaataacaagactggataatctaatgtggaaacaaataacaccagaactgaatcacattctatcagaaaatgaggtaaagttgtctatcatgacaggggacatcaaaggaatcatgcaggcaggaaaacgatccctgcggcctcagcccactgagctgaaatattcatggaaaacgtggggcaaagcgaaaatgctctccacagagcctcataaccagacctttctcattgatggccccgaaacagcacaatgtcccaacacaaacagagcttggaactcactagaagttgaagactatggctttggggtattcaccaccaacatatggctgaagttgaaagaaaggcaggatgtgttttgtgactcaaaactcatgtcagcggccataaaagacaacagagccgtccatgccgatatgggttattggatagaaagcgcacttaatgacacatggaagatagaaaaagcttcttttatcgaagttaaaagttgccactggccaaaatcacacactctctggagtaacggagtgctagaaagtgagatgataattccaaagaattttgctggaccagtatcgcaacacaattacagaccaggctatcacacacaaacggcaggaccttggcatctaggcaagcttgagatggactttgatttttgcgaaggaaccacagtggtggtgactgaggactgcggaaatagaggaccctctctaagaacaactactgcttctggaaaactcataacagaatggtgctgccgatcctgcacattaccaccactcagatacagaggcgaggatggatgctggtacggaatggaaatcagaccattgaaagagaaagaagagaacttggtcaattctttggtcacagccggacatggacagattgacaacttctcactaggagtcttgggaatggcactgttcctggaagaaatgctcaggacccgagtaggaacaaaacatgcagtattactggttgcagtttctttcatgacattgatcacagggaacatgtctttccgagacctggggagagtgatggttatggtgggggccgctatgacggatgacataggtatgggcgtgacttatcttgccttactagcagccttcaaagttagaccaacttttgcagctggactgcttttgagaaagctgacctccaaggaattgatgatgaccaccataggaatcgtactcctctcccagagcaccacaccagagactatacttgaactgactgatgcgttggctttgggcatgatgattctcaagatagtgagaaacatggaaaagtatcaattggcagtgactatcatggctatcttatgtgttccaaatgcagtgatattacaaaatgcatggaaagtgagctgcacaatactggcagcggtgtccgtatccccactgctcttaacatcttcgcagcagaaagcggattggataccattggcattgacgatcaaaggtctcaatccaacagctattttcctaacaaccctttcaagaactaacaagaaaaggagttggccactaaatgaggctatcatggcagtcgggatggtgagcattttagctagttctctcttgaagaatgacattcccatgacaggaccattagtggctggagggcttctcactgtgtgttacgtgctcactggaagatcggccgacctggaactagagagagccgccgacgttagatgggaagatcaggcagaaatatcaggaagtagtccaattctgtcaataacaatatcggaagatggcagcatgtcgataaaaaatgaagaggaagaacaaacactgaccatactcattagaacaggattgctggtgatatcaggacttttccccgtatcaataccaatcacggcagcagcatggtacctgtgggaagtgaagaaacaacgggctggagtattgtgggatgttccttcacccccacctgtgggaaaggccgaactggaagatggagcttacagaatcaagcagaaagggattcttggatactcccagatcggagctggagtttacaaagaaggaacattccacacaatgtggcacgtcacacgtggtgctgttctaatgcacaaagggaagaggattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtctttttaagactaacaccggaaccataggcgctgtgtccctagacttttctcctggaacgtcaggatctccaatcgtcgacaaaaaaggaaaagtcgtgggtctctatggtaatggtgtcgtcacaaggagtggaacatatgtgagtgccatagcccagactgaaaaaagcattgaagacaatccagagattgaagacgatatctttcgaaaaaaaagattgaccattatggacctccacccaggagcgggaaagacgaaaagataccttccagcaatagttagagaggccataaaacgaggcttaagaacattaatcctggcccccactagagtcgtggcagctgaaatggaggaagctcttagaggacttccaataagataccaaaccccagccatcagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagctagaggatacatttcaactcgagtagaaatgggtgaagcagctgggattttcatgacagccactcccccgggaagcagagacccatttcctcaaagcaatgcaccaatcatggatgaagagagggaaatccctgaacgttcgtggaactctggacatgagtgggttacagatttcaaagggaagactgtttggtttgttccgagcataaaagcaggtaatgatatagcagcttgcctgagaaaaaatggaaagaaagtgatacaactcagtaggaagacctttgattctgaatacattaagaccaggaccaatgattgggactttgtggtcacgactgacatttcagaaatgggtgctaacttcaaggctgaaagggttatagaccccaggcgctgcatgaaaccagtcatactaacggacggtgaagagcgggtgatcctggcaggacccatgccagtgacccactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaggtggatgctattgatggtgaataccgcttaagaggagaagcgaggaaaacctttgtggatctaatgagaagaggagacctaccagtctggctggcctacagagtggcagccgaaggcattaactatgcagacagaaggtggtgttttgatggaatcaagaacaaccaaatcttagaagaaaatgtggaagtggaaatctggacaaaagaaggggaaaggaagaaactgaaacccagatggctggatgctcggatctactctgacccactggcgctcaaagaattcaaagagtttgcagctgcaagaaaatccctgaccctgaatttaatcacagaaatgggtaggctcccaacttttatgactcagaaagcaaggaacgcactggacaacttagcagtcctgcatacggctgaagcaggcggaagggcgtacaaccatgctctcagtgaactgccagagactctggagacattgcttttgctgacacttttggccacagtcacgggcggaatctttttatttttgatgagtggcaaaggtatagggaaaatgaccctgggaatgtgctgcataatcacggccagtattctcctatggtacgcacaaatacagccacactggatagcagcttcaataatactggagttttttctcatagtcttgctcattccagagccagaaaagcaaagaacaccccaagataaccaattgacttacgttgtcatagccatcctcacagtggtggccgcaaccatggcaaatgagatggggttcctggaaaaaacgaagaaagatttcggactgggaagcattgcaacccagcaacccgagagcaacatcctggacatagatctacgtcctgcatcagcatggaccctgtatgcagtggccacaacatttatcacaccaatgttgagacatagcattgaaaattcctcagtgaacgtgtctctaacagccattgctaatcaagccacagtgctaatgggtcttgggaaaggatggccattgtcgaagatggacattggagttccccttctcgccatcgggtgctattcacaagtcaaccccataaccctcacagcagcccttcttttattggtagcacattacgctatcatagggccaggactccaagcgaaagcatccagagaagcgcagaaaagagcagcagcaggcatcatgaaaaacccaactgtggatggaataacagtgattgacctagatccaataccctatgacccaaaatttgagaagcagctgggacaagtaatgctcctaatcctctgcgtgactcaagtactgatgatgaggactacatgggctttgtgcgaggctctaaccttagcgaccgggcccatctccacattgtgggaaggaaatccagggagattctggaatacaaccattgcagtgtcaatggctaacatttttagaggaagttacctagctggagctggacttctcttttccatcatgaagaacacaaccaacacaagaaggggaactggcaacacaggagagacgcttggagagaaatggaaaaaccgagtgtcattgttggggaagagtgaattccagatttacaagagaagcggaattcaggaagtggatagaaccttggcaaaagaaggcattaaaagaggagaaacggaccatcatgctgtgtcgcgaggctcagcaaagctgagatggttcgtcgagagaaacctggttacaccagaggggaaagtagtggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctcctaactggagctgatgttttctttactccaccagaaaaatgtgacacattgttgtgtgatataggggagtcgtcaccaaatcccacggttgaagctggacgaacactcagagtcctaaacttggtagaaaattggctgaacaacaacacccaattttgtataaaggttcttaacccatacatgccctcagtcatagaaaaaatggaaacgctgcaaaggaaatacggaggagctttggtgaggaatcccctctcaagaaattccacacatgagatgtattgggtatccaatgcttccgggaacatagtgtcatcagtgaacatgatttcaaggatgttgatcaatagatttacaatgagacataagaaggccacatacgacccagatgttgacctcggaagcggaacccgcaacatcggaatcgaaagtgaaacaccaaacctagacataattgggaaaagaatagaaaaaataaaacaagagcatgagacatcacggcactatgaccaagaccacccatataaaacttgggcctaccatggcagctacgaaacaaaacagactggatcagcatcatccacggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactagggaagaaaaagacacctagaatgtgcactagagaagaattcgcaagaaaggtgagaagcaatgcagccctaggtgccatattcactgatgagaacaagtggaagtcggcacgtgaggctgttgaagacagtagattttgggaactagttgacaaggaaaggaatctccatcttgaaggaaagtgtgagacatgtgtgtacaacatgatgggaaagagagagaagaagataggggaattcggcaaagcaaaaggcagcagagccatatggtacatgtggcttggagcacgcttcttagagtttgaagccctaggatttctgaatgaagatcactggttttccagagagaactctctgagcggagtggaaggagaagggctgcacaagctgggttacattctaagagaagtgagcaagaaagaaggaggagcaatgtacgccgacgacacagcaggatgggatacaagaatcacactagaggacctaaaaaatgaagagatggtaacaaaccatatggaaggagaacacaagaaacttgctgaggccatcttcaaattaacgtaccaaaacaaggtggtgcgtgtgcaaagacccacaccaagaggcacagtaatggatattatatcgagaagagaccaaagaggtagtgtacaagttggtacctatgggctcggcacctttaccaatatgggagcccaactaatcagacagatggagggagagggagtctttaaaggcatccagcatctgacagccacagaagaagttgcagtgcaagactggttagcaagagtggggcgtgagaggttatcaagaatggccatcagtggagatgattgtgttgtgaaacccttagatgacaggtttgcaagcgctttaacagctctaaatgacatgggaaaggttaggaaagacatacaacaatgggaaccttcaagaggatggaacgactggacacaagtgcctttctgttcacaccatttccatgagttaatcatgaaagacggtcgtgtgctcgtagttgcatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcagcaaatgctatttgctcggcagttccatcacattgggttccgacaagtcgaacaacctggtccatacacgccggacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagggccacctgggcaaggaacatccaaacagcaataaaccaagttagatccttaataggcagtgaggaatacacagactacatgccatccatgaaaagattcggaagagaagaggaagaggcaggggtcttgtggtag

SEQ ID NO: 6408 - RNA, 9876 nt, synthetic construct
  misc_feature 1..9876: note = derived and/or modified CDS sequence (wt) from DENV-2__KX380809__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgactaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaatgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctattggatgctattcacaagtcaaccccataactctcacagcagcccttctcttattggtagcacactatgctatcatagggccaggactccaagcgaaagcaactagagaggctcagaaaagagcagcagcgggtatcatgaaaatcccaactgtggatggaataacagtgattgacctagatccaataccctatgatccaaagtttgagaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6409 - RNA, 9876 nt, synthetic construct
  misc_feature 1..9876: note = derived and/or modified CDS sequence (wt) from DENV-2__KX380810__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacaggaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaacgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctattcacaagtcaaccccataactctcacagcagcccttctcttattggtagcacactatgctatcatagggccaggactccaagcgaaagcaactagagaggctcagaaaagagcagcagcgggtatcatgaaaatcccagctgccgacatcggaacagtgattgacctagatccaataccctatgatccaaagtttgagaagcagttgggacaagtaatgctcttagtcctctgttctactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6410 - RNA, 9876 nt, synthetic construct
  misc_feature 1..9876: note = derived and/or modified CDS sequence (wt) from DENV-2__KX380811__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaacctcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttagggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaacctttatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaatcccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagctacctggccggggccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6411 - RNA, 9876 nt, synthetic construct
  misc_feature 1..9876: note = derived and/or modified CDS sequence (wt) from DENV-2__KX380813__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaatctgcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggttcaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcacttcgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgcgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaagaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6412 - RNA, 9876 nt, synthetic construct
  misc_feature 1..9876: note = derived and/or modified CDS sequence (wt) from DENV-2__KX380814__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggttcaagaaaggaagttctattggccaaatgtttgagacaacaatgagaggagcgaagagaatggccattttaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcacttcgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgcgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaagaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6413 - RNA, 9876 nt, synthetic construct
  misc_feature 1..9876: note = derived and/or modified CDS sequence (wt) from DENV-2__KX380807__SS-prME
  source 1..9876: mol_type = other RNA
actgcaggcataattatcatgatgattccaacagtgatggcgttccatttaaccacacgcaacggagaaccacacatgatcgtcagtagacaagagaaagggaaaagtcttctgtttaaaacagagaatggtgtgaacatgtgtaccctcatggccatggaccttggtgaactatgtgaagacacaatcacttataattgtcctcttctcaggcagaatgaaccagaagacatagactgttggtgcaactctacgtctacatgggtaacttacgggacatgcaccgccacaggagaacacagaagggaaaaaagatcagtggcactcgctccacatgtgggaatgggactggagacacgaactgaaacatggatgtcatcagaaggggcctggaaacatgcccagagaattgaaatttgggtcttgagacatccaggcttcaccataatggcagcaatcctggcttacaccataggaacgacatatttccaaagagtcctgatctttatcttactgacagctgtcgctccctcaatgacaatgcgctgcataggaatatcaaatagggactttgtggaaggggtatcaggaggaagctgggttgacatagtcttggaacatggaagctgtgtgacgacgatggcgaaaaataaaccaacattggattttgaactgatcaaaacagaagccaaacaccccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaaaggaggtatcgtgacctgtgcaatgttcacatgcaaaaagaacatggaagggaaaatcgtgcaaccagagaacctggagtacaccattgtgataacaccccactcaggggaagagaatgcagtcggaaatgacacagggaaacacggcaaggaaattaaagtaacaccacagagttccatcacagaagcagaactaacaggctatggcactgttacgatggaatgctctccgagaacgggcctcgacttcaatgagatggtgttgctgcaaatggaaaacaaggcttggctggtgcacaggcaatggttcttagacttgccgttaccatggctgcccggagcagacacacaaggatcaaactggatacagaaggagacattggtcactttcaaaaatccccatgcaaagaaacaggatgttgtcgttttaggatcccaagaaggggccatgcacacagcactcacaggggccacggaaatccagatgtcatcaggaaacttactgttcacaggacatcttaagtgcaggctgagaatggataaactacagctcaaaggaatgtcatattccatgtgtacaggaaagtttaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggggacagctacatcattataggagtagaaccaggacaactgaagctcagctggtttaagaaaggaagttctattggccaaatgtttgagacaacaatgagaggagcgaagagaatggccattttaggtgacacagcttgggattttggatccttgggaggggtgttcacatccataggaaaggccctccaccaagtctttggagcaatctatggggctgccttcagtggggtttcatggactatgaaaatcctcataggagtcgtcatcacatggataggaatgaattcacgcagcacctcactgtctgtgtcactagtactagtgggggtcgtgacactgtatttgggagttatggtgcaggccgatagtggttgcgttgtgagttggaaaaacaaagaactgaaatgtggcagtgggatttttatcacagacaacgtacacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattttatcagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaagttgaagactatggctttggagtatttaccaccaacatatggctgaaattgaaagaaaggcaggatgtattttgtgactcaaaactcatgtcagcagccataaaagacaacagagccgtccacgccgatatgggttattggatagaaagcgcactcaatgacacatggaagattgagaaagcctcttttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggacttcgatttctgcgaaggaaccacagtggtggtgactgaggactgtggaaatagaggaccctctttaagaacaaccaccgcttctggaaaactcataacagagtggtgctgccgatcctgcacattaccaccgctaaggtacagaggtgaggatggatgctggtatggaatggaaattagaccattgaaagagaaggaagagaacttggtcaactctttggtcacagccggacatggacagattgacaacttctcactaggagtcttgggaatggcactgttcctggaagagatgctcaggacccgagtgggaacaaaacacgcaatattactagttgcagtttctttcgtgacattgatcacagggaacatgtcctttcgagatttggggagagtgatggtcatggtgggcgctactatgacggataacataggcatgggcgtgacttatcttgccctattagcagccttcaaagtcagaccaacttttgcagctggactactcttaagaaagctgacctccaaggaattgatgatgaccaccataggaatcgtgctcctctcccagagcaccataccagagactatacttgaactgactgacgcgttggctttggggatgatggttctcaaaatagtgagaaacatggaaaagtatcaactagcagtgactatcatggccatcttgtgcgtcccaaatgcagtgatattacaaaacgcatggaaagtgagctgcacaatactggcagtggtgtccgtttccccactgcttttaacatcctcacagcagaaagcggattggataccactggcgttgacgataaaaggcctcaatccaacagccattttcttaacaaccctctcgagaactagcaagaaaaggagctggccactaaatgaggctattatggcagtcgggatggtgagcattttagccagttctctcttaaagaatgatattcccatgacagggccattagtggctggagggcttctcactgtgtgttacgtgctcactggaagatcggccgatttggaactggagagagctgctgacgtaagatgggaagaacaggcagagatatcaggaagcagtccaattctgtcaataacaatatcagaagatggtagcatgtcgataaaaaatgaagaagaagaacaaacgctgaccatactcatcagaacaggactgttggtgatatcaggactttttcccgtgtcaataccaatcacggcagctgcatggtacctgtgggaagtgaaaaaacaacgagcaggagtattgtgggatgtcccttcacccccacctgtgggaaaggccgaactggaagatggagcctatagaatcaagcagaaagggattctaggatactcgcagatcggagccggagtttacaaagaaggaacattccacacaatgtggcatgtcacacgtggtgctgtcctaatgcataaagggaagagaattgaaccatcatgggcggacgtcaagaaagatctaatatcatacggaggaggttggaagctagaaggagaatggaaggaaggagaagaagtccaggtcctggcattagagcctggaaagaatccaagagccgtccaaacaaaaccaggtctttttaaaactaacactggaaccataggcgccgtgtctctggacttttctcctggaacgtcaggatctccaatcgtcgacaaaaaagggaaagttgtgggcctctacggcaacggtgtcgttacaaggagtggaacatatgtgagtgccatagcccagactgaaaaaagcatcgaggacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccaccagagttgtggcggctgaaatggaagaagctctcagaggacttccaataagataccaaactccagctatcagagctgagcacactgggcgggagattgtggatctaatgtgtcacgccacatttaccatgaggctactatcaccaattagagtgccaaattacaatctgattatcatggatgaagcccatttcacagacccagcaagcatagcagctagaggatacatttcaactcgagtagagatgggtgaagctgctgggattttcatgacagctacccctcctggaagcagagacccatttcctcagagcaatgcaccaatcatggatgaagaaagggaaatccctgagcgttcgtggaactctggacatgagtgggttacggactttaaagggaagactgtttggtttgttccaagtataaaagcagggaatgatatagcagcttgcttgagaaagaatggaaagaaagtgatacaactcagcaggaagacttttgattctgaatatattaagactaggaccaatgattgggactttgtggtcacgacagacatttcagaaatgggtgcaaacttcaaggctgagagggttatagaccccagacgctgcatgaaaccagtcatactaacagacggtgaagagcgggtgatcttggcaggacccatgccagtgacccactctagcgcagcacaaagaagagggagagtaggaagaaatccaaaaaacgaaaatgaccagtacatatacatgggggaacctctggaaaatgatgaagactgtgcgcactggaaagaagccaaaatgcttctagacaacatcaacacccctgaaggaatcattcccagcatgttcgaaccagagcgtgaaaaggtggatgctgttgatggtgaataccgcttgagaggagaagcaaggaaaactttcgtggacctaatgagaagaggagacctaccagtctggttagcctacaaagtggcagctgaaggcatcaattacgcagacagaagatggtgctttgatggagtcaaaaataaccaaatcttagaggaaaatgtggaagtggaaatttggacaaaagaaggagaaaggaagaaattaaaacccagatggttggatgctaggatctactctgacccactggcgctcaaagaattcaaggaattcgcagctggaagaaagtccctgaccctgaatctaatcacagagatgggtaggctcccaaccttcatgacccagaaagcaaggaatgcactggacaacttagcagtcttgcatacagctgaagcaggcggaagggcgtacaatcatgctctcagtgaactgccggagactctggagacattgcttttactgacactcttggccacagtcacgggcggaatcttcctgttcttgatgagtggaaaaggtatagggaagatgaccctgggaatgtgctgcataatcactgccagtattctcctatggtatgcacaaatacagccacattggatagcagcttcaataatactggagttttttctcatagtcttgctcattccagaaccagaaaagcagagaacaccccaagataaccaattaacctatgttgtcatagccatccttacagtggtggccgcaaccatggcaaacgagatgggtttcctggaaaaaacaaagaaagatttcggattgggaagcatcacaacccagcaacctgagagcaatatcctggacatagatctacgtcctgcatcagcttggactctatatgccgtggcaacaactttcatcacaccaatgttgagacatagcattgaaaactcctcagtgaatgtgtctctaacagccattgccaaccaggccacagtgttaatgggtcttgggaaaggatggccgttgtcaaaaatggacatcggagttccccttctcgctatcgggtgctattcacaagtcaaccccataactctcacagcagcccttctcttattggtagcacattatgctatcatagggccaggactccaagcgaaagcaactagagaggctcagaaaagaacagcagcgggcatcatgaaaatcccagctgccttgatagtaacagtgattgacctagatccaataccctatgatccaaagtttgaaaagcagttgggacaagtaatgctcttagtcctctgttctactcaagtattgatgatgaggactacatgggctttatgtgaagctctaaccttagcaactgggcccatctctacactgtgggaaggaaatccaggaagattctggaatacaactattgcagtgtcaatggctaacattttcagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaaccttagcaaaagaaggcatcaaaagaggagaaacagaccatcacgctgtgtcgcgaggctcggcgaaactgagatggttcgtcgagagaaacctggtcacaccagaagggaaagtagtggaccttggttgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgttttctttactccgccagaaaagtgtgacacattgctgtgtgacataggggagtcgtcaccaaaccccacggttgaagcaggacggacactcagagttctaaccttagtggaaaattggctgaataacaacacccaattttgcataaaggttctcaacccatatatgccctcagttatagaaaaaatggaagcgctacaaaggaaatacggaggagctttggtgaggaatccactctcaagaaattccacacacgagatgtactgggtatccaatgcttccgggaacatagtgtcatcagtgaatatgatttcaagaatgttgattaatagattcacaatgagacacaagaaggccacatacgagccagatgttgacctcggaagtggaacccgcaacatcggaattgaaagtgagacaccaaatttagacataattgggaaaagaatagaaaaaataaaacaagagcatgaaacatcatggcactacgaccaagaccacccatacaaaacgtgggcctaccatggcagctacgaaacaaaacagactggatcagcatcatccatggtgaacggagtggttaggctgctaacaaaaccttgggacgttatccctatggtgacacagatggcaatgacagacacgactccatttggacaacagcgcgttttcaaagagaaagtggatacgagaacccaagaaccgaaagaaggcacgaaaaagctaatgaaaatcacggcagaatggctctggaaagaactaggaaagaaaaagacacctaggatgtgcaccagagaagaattcacgagaaaggtgagaagcaatgcagccttaggcgccatattcactgatgagaacaagtggaagtcggcacgtgaggctgttgaagacagtggattttgggaattggttgacaaggaaaggaatctccatcttgaaggaaagtgtgagacatgtgtatataacatgatgggaaagagagagaagaagctaggggagttcggcaaagcgaaaggcagcagagccatatggtacatgtggcttggagcacgcttcttagagtttgaagccctaggattcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaagaaacttgctgaagccatcttcaaattaacgtaccaaaacaaagtggtgcgtgtgcaaagaccaacaccaagaggcacagtaatggacattatatcgagaagagaccaaagaggtagtggacaagttgttacctacggcctcaatactttcaccaacatggaagcccaactgatcagacagatggagggagaaggagtcttcaaaagcatccagcaactaacagccacggaagaaattgcagtgaaaaactggctagtaagagtggggcgtgagaggttatcaagaatggccatcagtggagatgattgtgttgtgaaacccttagatgacaggtttgcaagcgctctaacagctctaaatgacatgggaaaagttaggaaagacatacaacaatgggaaccttcaagaggatggaacgattggacacaagtgcctttttgttcacaccatttccatgagttaatcatgaaggacggtcgcgtactcgtagttccatgcagaaatcaagatgaactgattggtagggcccgaatttcccagggagccgggtggtccttgcgggaaacagcctgtttggggaagtcttacgcccaaatgtggagcctgatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagatttagaagagaagaggaagaggcaggagtcttgtggtag

SEQ ID NO: 6414 - RNA, 9876 nt, synthetic construct
  misc_feature 1..9876: note = derived and/or modified CDS sequence (wt) from DENV-2__KX380815__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgttgctccctcaatgacaatgcgttgtataggaatatcaaatagagactttgtggaaggggtttcaggaggaagctgggttgacatagtcttggaacatggaagctgtgtgacgacgatggcaaaaaataaaccaacattggattttgaactgataaagacagaagcaaaacatcccgccactctaaggaagtattgcatagaggcaaagctgaccaacacaacaacagcatctcgctgcccaacacaaggagaacccagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttctaggatcccaagaaggggctatgcacacagcacttacaggggccacggaaatccagatgtcatcaggaaacttactgttcacaggacatcttaaatgtaggctgagaatggataaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcatacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctaacagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgagacagcagaatgtcccaacacaaatagagcttggaactcactagaggttgaagactatggctttggagtattcaccactaacatatggctgaaattgaaagaaaggcaggatgtatcttgtgactcaaaactcatgtcggcagccataaaagacaacagagccgtccacgccgacatgggttattggatagaaagcgcactcaatgacacatggaagattgagaaagcctcctttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctccttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgcttagaacccgagtagggacgaaacatgcaatattactagttgcagtctctttcgtgacattgatcacagggaacatgtcctttcgagacttggggagagtgatggtcatggtgggcgctactatgacggatgacataggcatgggcgtgacctatcttgccctattagcagccttcaaggtcagaccaacttttgcagctggactactcttaagaaaactgacctccaaggaattgatgatgaccaccataggaatcgtactcctctctcagagcaccataccagagaccatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaaacggattggataccactggcgttgacgatcaaaggccttaatccaacagccattttcttaacaaccctctcaagaactagcaagaaaaggagctggccactaaatgaggctattatggcagtcgggatggtgagcattttagccagttctttcttaaagaatgatattcccatgacaggaccactagtggctggagggcttctcactgtgtgttacgtgctcactggaagatcggctgatttggaactggagagagctgctgacataagatgggaagaacaggcagagatatcaggaagcagtccaattttgtcgataacaatatcggaagatggcagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtgttgtgggatgtcccttcacctccacctgtgggaaaggccgaactggaagatggagcctatagaatcaagcagaaagggattttgggatactcgcagataggagccggagtctacaaagaaggaactttccacacaatgtggcatgtcacacgtggtgctgttctaatgcataaagggaagagaattgaaccatcatgggcggacgtcaagaaggacctaatatcgtatggaggaggttggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaaacattgaagacaacccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagatatcaaaccccagctatcagagctgagcatactggacgggagatcgtggatctaatgtgtcacgccacatttaccatgaggctactatcaccaattagagtgccaaattacaacctgattatcatggatgaagcccatttcacagacccagcaagcatagcggctagaggatacatctcaactcgagtagagatgggtgaagcagctgggattttcatgacagctacccctcctggaagcagagacccatttcctcagagcaacgcaccaatcatggatgaagaaagggaaattcctgagcgttcgtggaactctggacatgagtgggttacggattttaaagggaagactgtttggtttgttccaagtataaaagcaggaaatgatatagcagcttgcctgagaaagaatgggaagaaagtgatacaactcagcaggaagacctttgattctgaatatgtcaagactaggaccaatgattgggactttgtggtcacgacagacatctcagaaatgggtgctaacttcaaggctgagagggttatagaccccagacgctgcatgaaaccagtcatactaacagacggtgaagagcgggttatcctggcaggacccatgccagtgacccactctagtgcagcacaaagaagagggagagtaggaagaaatccaaaaaatgaaaatgaccagtatatatacatgggggaacctctggaaaatgatgaagactgcgcacactggaaagaagctaagatgcttctagataacatcaacacgcctgaaggaatcattcccagcatgtttgaaccagagcgtgagaaggtcgacgccattgatggtgaataccgcttgagaggagaagcgaggaaaacatttgtggacctaatgagaagaggagacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcacttaaagaattcaaggaattcgcagctggaagaaaatccctgaccctgaatctaatcaccgagatgggtaggctcccaaccttcatgacccagaaagcaaggaatgcattggacaacttagcagtcctacacacggctgaagcaggcggaagggcgtacaatcatgctcttagtgaactgccggagactctggagacattgcttttactgacacttttggccacagtcacaggcggaatcttcctgttcttgatgagcggaaagggtatagggaagatgaccctgggaatgtgctgcatagtcacagccagtattcttctatggtatgcacaaatacagccacattggatagcagcttcaataatactagagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagtatcacaacccagcaacctgagagcaacatcctagacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaatcccataactctcacagcagcccttctcttattggtagcacattatgctatcatagggccaggactccaagcgaaagcaaccagagaggctcagaaaagagcagcagcgggcatcatgaaaatcccagctgccttgatcatgacagtgattgacctagatccaataccatatgatccaaagtttgaaaagcagttgggacaagtaatgctcttagtcctctgttctactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccagttgaatgcattggggaagagtgaattccagatctataagaaaagtggaatccaggaagtggatagaacgttagcaaaagaaggcatcaagagaggagaaacggaccatcacgctgtgtcgcgaggctcagcgaaactgagatggttcgtcgagagaaaccttgtcacaccagaagggaaagtagtggaccttggctgcggcagggggggctggtcatactattgtgggggactaaagaatgtaaaggaagtcaaaggcctaacaaaaggaggaccaggacacgaagaacccattcccatgtcaacatatggttggaatctggtgcgtctgcaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaataatacccaattttgcataaaggttcttaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgaagtaccaaatctagacataattgggaaaagaatagaaaaaataaaacaagagcatgaaacatcatggcactatgatcaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccaaaagaaggtacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaagctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctgggattcttgaatgaagatcactggttttccagagagaactccctgagtggagtagaaggagaagggctgcacaaactaggctacattctaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaggttgtcacctacggcctcaacactttcaccaacatggaagcccaactgatcagacagatggagggagaaggagtcttcaaaagcatccagcacctgacagccacagaagaaattgcagtgaaaaactggttagtaagagtggggcgtgagaggttatcaagaatggccatcagcggagatgattgtgttgtgaaacccttagatgacaggtttgcaaacgctctaacagctttaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcttgtttggggaagtcttacgcccaaatgtggagcctaatgtacttccacagacgtgaccttaggctggcggcaaatgccatttgctcggcagtcccttcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaagagagaagaccagtggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6415 - RNA, 9876 nt, synthetic construct
  misc_feature 1..9876: note = derived and/or modified CDS sequence (wt) from DENV-2__KX380816__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggttcaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagatatcttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaggcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggcatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcacttcgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaggaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaagaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6416 - RNA, 9876 nt, synthetic construct
  misc_feature 1..9876: note = derived and/or modified CDS sequence (wt) from DENV-2__KX380817__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaagcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaaataacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatctcgtgcgttccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagcagtccaattctgtcgataacaatatcggaagatggtagcatgtcgataaagaatgaagaagaagaacagacactgaccatactcatcagaacaggactactagtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacagggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgccgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacctttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6417 - RNA, 9876 nt, synthetic construct
  misc_feature 1..9876: note = derived and/or modified CDS sequence (wt) from DENV-2__KX380818__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggatcttggtgaactgtgtgaagacacaatcacttacaattgtcctcttctcaggcagaatgaaccagaagacatagactgttggtgcaactctacgtctacatgggtaacttatgggacatgcaccgctacaggagaacacagaagggaaaaaagatcagtggcactcgttccacatgtgggaatgggactggagacacgaactgaaacatggatgtcatcagaaggggcctggaaacatgcacagagaattgaaacttgggtcttgagacatccaggcttcaccataatggcagcaatcctggcatacaccataggaacgacatatttccaaagagtcctgattttcatcttactgacagctgttgctccctcaatgacaatgcgttgtataggaatatcaaatagagactttgtggaaggggtttcaggaggaagctgggttgacatagtcttggaacatggaagctgtgtgacgacgatggcaaaaaataaaccaacattggattttgaactgataaagacagaagcaaaacatcccgccactctaaggaagtattgcatagaggcaaagctgaccaacacaacaacagcatctcgctgcccaacacaaggagaacccagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaagggaaaatcgtgcaaccagaaaacttggagtacaccattgtgataacacctcactcaggggaagagaatgcagtcggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttctaggatcccaagaaggggctatgcacacagcacttacaggggccacggaaatccagatgtcatcaggaaacttactgttcacaggacatcttaaatgtaggctgagaatggataaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccgggacaactgaagctcagctggtttaagaaaggaagctctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaatcctcataggagtcgtcatcacatggataggaatgaattcacgcagcacttcactgtctgtgtcactagtattagtgggagtcgtgacattgtatttgggagttatggtgcaggccgatagtggttgcgttgtgagctggaaaaacaaagaactgaaatgtggcagtgggatttttatcacagacaacgtgcatacatggacagaacaatacaaattccaaccagaatccccttcaaagctggcttcagctatccagaaggctcatgaagaaggcatttgtggaatccgctcagtaacaagactggagaatctgatgtggaaacaaataacaccagaactgaatcacattctaacagaaaatgaggtaaagttgactatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgagacagcagaatgtcccaacacaaatagagcttggaactcactagaggttgaagactatggctttggagtattcaccactaacatatggctgaaattgaaagaaaggcaggatgtatcttgtgactcaaaactcatgtcggcagccataaaagacaacagagccgtccacgccgacatgggttattggatagaaagcgcactcaatgacacatggaagattgagaaagcctcctttattgaagttaaaagctgccactggccaaagtcacacactctctggagtaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctccttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgcttagaacccgagtagggacgaaacatgcaatattactagttgcagtctctttcgtgacattgatcacagggaacatgtcctttcgagacttggggagagtgatggtcatggtgggcgctactatgacggatgacataggcatgggcgtgacctatcttgccctattagcagccttcaaggtcagaccaacttttgcagctggactactcttaagaaaactgacctccaaggaattgatgatgaccaccataggaatcgtactcctctctcagagcaccataccagagaccatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaaacggattggataccactggcgttgacgatcaaaggccttaatccaacagccattttcttaacaaccctctcaagaactagcaagaaaaggagctggccactaaatgaggctattatggcagtcgggatggtgagcattttagccagttctttcttaaagaatgatattcccatgacaggaccactagtggctggagggcttctcactgtgtgttacgtgctcactggaagatcggctgatttggaactggagagagctgctgacataagatgggaagaacaggcagagatatcaggaagcagtccaattttgtcgataacaatatcggaagatggcagcatgtcgataaaaaatgaagaagaagaacaaacactgaccatactgattagaacaggactgctggtgatatcaggactttttcccgtgtcaataccaatcacggcagctgcatggtacctgtgggaagtgaaaaaacaacgagccggagtgttgtgggatgttccttcacctccacctgtgggaaaggccgaactggaagatggagcctatagaatcaagcagaaagggattttgggatactcgcagataggagccggagtctacaaagaaggaactttccacacaatgtggcatgtcacacgtggtgctgttctaatgcataaagggaagagaattgaaccatcatgggcggacgtcaagaaggacctaatatcgtatggaggaggttggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaaacattgaagacaacccagagattgaagatgacatctttcgaaagaaaagactgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagatatcaaaccccagctatcagagctgagcatactggacgggagatcgtggatctaatgtgtcacgccacatttaccatgaggctactatcaccaattagagtgccaaattacaacctgattatcatggatgaagcccatttcacagacccagcaagcatagcggctagaggatacatctcaactcgagtagagatgggtgaagcagctgggattttcatgacagctacccctcctggaagcagagacccatttcctcagagcaacgcaccaatcatggatgaagaaagggaaattcctgagcgttcgtggaactctggacatgagtgggttacggattttaaagggaagactgtttggtttgttccaagtataaaagcaggaaatgatatagcagcttgcctgagaaagaatgggaagaaagtgatacaactcagcaggaagacctttgattctgaatatgtcaagactaggaccaatgattgggactttgtggtcacgacagacatctcagaaatgggtgctaacttcaaggctgagagggttatagaccccagacgctgcatgaaaccagtcatactaacagacggtgaagagcgggttatcctggcaggacccatgccagtgacccactctagtgcagcacaaagaagagggagagtaggaagaaatccaaaaaatgaaaatgaccagtatatatacatgggggaacctctggaaaatgatgaagactgcgcacactggaaagaagctaagatgcttctagataacatcaacacgcctgaaggaatcattcccagcatgtttgaaccagagcgtgagaaggtcgacgccattgatggtgaataccgcttgagaggagaagcgaggaaaacatttgtggacctaatgagaagaggagacctaccagtttggctagcctacagagtggcagctgaaggtatcaactacgcagacagaagatggtgctttgatggagtcaagaacaaccaaatcttggaagaaaatgtggaagtggaaatttggacaaaagaaggagaaaggaagaaattaaaacccagatggttagatgctaggatctactctgacccactggcacttaaagaattcaaggaattcgcagctggaagaaaatccctgaccctgaatctaatcaccgagatgggtaggctcccaaccttcatgacccagaaagcaaggaatgcattggacaacttagcagtcctacacacggctgaagcaggcggaagggcgtacaatcatgctcttagtgaactgccggagactctggagacattgcttttactgacacttttggccacagtcacaggcggaatcttcctgttcttgatgagcggaaagggtatagggaagatgaccctgggaatgtgctgcatagtcacagccagtattcttctatggtatgcacaaatacagccacattggatagcagcttcaataatactagagttttttctcatagtcttgctcattccagaaccagaaaagcagagaacaccccaagataaccaattaacttatgttgtcatagccatccttacagtggtggccgcaaccatggcaaacgagatgggtttcctggaaaaaacaaagaaagatttcggattgggaagtatcacaacccagcaacctgagagcaacatcctagacatagatctacgtcctgcatcagcttggactctatatgccgtggcaacaactttcatcacaccaatgttgagacatagcattgaaaattcctcagtgaatgtgtctctaacagccattgccaaccaagccacagtgttaatgggtcttgggaaaggatggccattgtcgaaaatggacatcggagttccccttctcgctatcggatgctattcacaagtcaatcccataactctcacagcagcccttctcttattggtagcacattatgctatcatagggccaggactccaagcgaaagcaaccagagaggctcagaaaagagcagcagcgggcatcatgaaaatcccagctgccgatatcggaagagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctggccggagccggacttctcttttctatcatgaagaacacggccaacacaagaaggggaactggcaacacaggagagacgcttggagagaaatggaaaaaccagttgaatgcattggggaagagtgaattccagatctataagaaaagtggaatccaggaagtggatagaacgttagcaaaagaaggcatcaagagaggagaaacggaccatcacgctgtgtcgcgaggctcagcgaaactgagatggttcgtcgagagaaaccttgtcacaccagaagggaaagtagtggaccttggctgcggcagggggggctggtcatactattgtgggggactaaagaatgtaaaggaagtcaaaggcctaacaaaaggaggaccaggacacgaagaacccattcccatgtcaacatatggttggaatctggtgcgtctgcaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaataatacccaattttgcataaaggttcttaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgaagtaccaaatctagacataattgggaaaagaatagaaaaaataaaacaagagcatgaaacatcatggcactatgatcaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccaaaagaaggtacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaagctgttgaagacagtggattttgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctgggattcttgaatgaagatcactggttttccagagagaactccctgagtggagtagaaggagaagggctgcacaaactaggctacattctaagagacgtgagtaagaaagaaggaggagcaatgtacgccgatgacaccgcaggatgggacacaagaatcacactagaggacttgaaaaatgaagaaatggtgacaaaccacatggaaggagaacacaagaaacttgctgaagccattttcagattaacgtaccaaaacaaagtggtgcgtgtgcaaagaccgacaccaagaggcacagtaatggacattatatcgagaagagaccaaagaggtagtggacaggttgtcacctacggcctcaacactttcaccaacatggaagcccaactgatcagacagatggagggagaaggagtcttcaaaagcatccagcacctgacagccacagaagaaattgcagtgaaaaactggttagtaagagtggggcgtgagaggttatcaagaatggccatcagcggagatgattgtgttgtgaaacccttagatgacaggtttgcaaacgctctaacagctttaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcttgtttggggaagtcttacgcccaaatgtggagcctaatgtacttccacagacgtgaccttaggctggcggcaaatgccatttgctcggcagtcccttcacattgggttccaacaagtcgaacaacctggtccatacacgccacacatgagtggatgacaacagaagacatgctgacagtctggaacagggtgtggattcaagaaaacccatggatggaagacaaaactccagtagaatcatgggaggaaatcccatatttggggaagagagaagaccagtggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6418 - RNA, 9876 nt, synthetic construct
  misc_feature 1..9876: note = derived and/or modified CDS sequence (wt) from DENV-2__KX380819__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaagggatttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagatacctcccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaatgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctattcacaagtcaaccccataactctcacagcagcccttctcttattggtagcacactatgctatcatagggccaggactccaagcgaaagcaactagagaggctcagaaaagagcagcagcgggtatcatgaaaatcccagctgccttgatcggaagagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagcctggaacagggtgtggattcaagaaaatccatggatggaagacaaaactccagtagaatcatgggaggaaatcccatatctggggaaaagagaagaccagtggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6419 - RNA, 9876 nt, synthetic construct
  misc_feature 1..9876: note = derived and/or modified CDS sequence (wt) from DENV-2__KX380821__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagttctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttagccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaggaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggggtcttgtggtag

SEQ ID NO: 6420 - RNA, 9876 nt, synthetic construct
  misc_feature 1..9876: note = derived and/or modified CDS sequence (wt) from DENV-2__KX380822__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatgactatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgacattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatataacagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcaaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaatgcattggacaacttagcagtcctgcatacggctgaagcaggcggaagggcgtacaaccatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctattcacaagtcaaccccataactctcacagcagcccttctcttattggtagcacactatgctatcatagggccaggactccaagcgaaagcaactagagaggctcagaaaagagcagcagcgggtatcatgaaaatcccagctgccgatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcgcaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggtaatgaggaatacacagactacatgccatccatgaaaagattcagaagagaagaggaagaggcaggagtcttgtggtaa

SEQ ID NO: 6421 - RNA, 9876 nt, synthetic construct
  misc_feature 1..9876: note = derived and/or modified CDS sequence (wt) from DENV-2__KX380828__SS-prME
  source 1..9876: mol_type = other RNA
actgcaggcgtgatcatcatgctaattccaacagcgatggcgttccatttaaccacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatacttccaaagagtcctaatcttcatcttactgacagccgtcgccccttcaatgacaatgcgttgtattggaatatcaaatagagactttgtggaaggggtttcaggaggaagctgggttgacatagtcctagaacatggaagctgcgtgacaacgatggcaaaaaacaaaccaacattggactttgaactgataaaaacagaagccaagcaacctgccactctaaggaagtactgtatagaagcaaagctgaccaacacaacaacagcatctcgatgcccaacacaaggagaacccagcctaaatgaagaacaggacaaaaggtttgtctgcaaacattccatggtagacagaggatggggaaatggatgtggattatttggaaagggaggcatcgtgacctgtgctatgttcacatgcaaaaaaaacatggaaggaaaaattgtgcaaccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgaaatggtgttgctgcaaatggaaaataaggcttggctggtgcacaggcaatggttcttagacctgccgttaccatggttgcccggagcggacacacaaggatcaaattggatacagaaggagatgttggtcaccttcaaaaacccccatgcgaagaaacaggatgttgttgttttaggatcccaagaaggggctatgcatacagcacttacaggggccacggaaatccagatgtcatcaggaaacctactgttcacaggacatcttaagtgcaggctgagaatggataaattacagctcaaaggaatgtcatactctatgtgtacaggaaagtttaaagttgtaaaagaaatagcagagacacaacatggaacaatagttgtcagagtacaatatgaaggggatggctctccatgtaagatcccttttgagataatggatttggaaaaaagacatgtcttaggtcgcctgattacagtcaacccaatcgtaacagaaaaagacagtccagtcaacatagaagcagaacctccatttggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtattcacatctataggaaaggccctccaccaagtttttggagcaatctatggggctgccttcagtggggtctcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggatttttatcacagacaatgtacacacatggacagaacaatacaaattccaaccagaatccccctcaaagctggcttcagctatccagaaagctcatgaagagggcatttgtggaatccgctcagtaacaagactagagaatctaatgtggaaacaaataacacccgaattgaatcacattctatcagaaaatgaggtaaagttgaccatcatgacaggagacatcaaaggtatcatgcaggcaggaaaacgatccctgcggcctcagcccactgagctgaagtattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtgttcaccaccaacatatggctgaagttgaaagaaaggcaggatgtgttttgcgactcaaagctcatgtcagcggccataaaagacaacagagccgtccatgccgatatgggttattggatagaaagcgcacttaatgacacatggaagatagaaaaagcttcttttattgaagtcaaaagttgccactggccaaaatcacacactctctggagcaatggagtgctagaaagtgagatgataattccaaagaattttgctggaccagtatcacaacataattacagaccaggctatcacacacaaacggcaggaccctggcatctaggcaagcttgagatggactttgatttttgcgaaggaaccacagtggtggtgactgaggactgtggaaatagaggaccctctctaagaacaactaccgcctctggaaaactcataacagaatggtgctgccgatcctgcacattaccaccactaagatacaaaggtgaggatggatgctggtacggaatggaaatcagaccattgaaagagaaagaagagaacttggtcaactccttggtcacagccggacatggacagattgacaacttctcactaggggtcttgggaatggcactgttcctggaagaaatgctcaggacccgagtaggaacaaagcatgcagtattactagttgcagtttctttcatgacactgatcacagggaacatgtctttccgagacctggggagagtgatggtcatggtgggggctgctatgacggatgacataggtatgggcgtgacttatcttgccttactagcagccttcaaagttagaccaacttttgcagctggactgcttttgagaaagctgacctccaaggaattgatgatgaccaccataggaattgtactcctctcccagagcaccataccagagaccatacttgaactgactgacgcgttggccttgggcatgatgattctcaagatagtgaggaatatggaaaagtatcaattagcagtgactatcatggctatcttatgtgctccaaatgcagtgatattacaaaatgcatggaaagtgagctgcacaatactggcagtggtgtccgtatccccactgctcttaacatcttcacagcagaaagcggattggataccattggcattgacgatcaaaggtctcaatccaacagccattttcctaacaaccctttcaagaaccaacaagaaaaggagttggccactaaatgaggctatcatggcagtagggatggtgagcattttagccagttctctcttgaagaatgacattcccatgacaggaccattagtggctggagggcttctcactgtgtgttacgtgctcactggaagatcggccgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggactttttcccgtatcaataccaattacggcagcagcatggtacctgtgggaagtgaagaaacaacgggctggagtattgtgggatgttccttcacccccacctgtgggaaaggccgaactggaagatggagcttatagaatcaagcagaaagggattcttggatactcccagatcggagctggagtttacaaagaaggaacattccacacaatgtggcacgtcacacgtggtgctgttctaatgcataaagggaagagaattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggtgctgtgtctctagacttttctcctggaacgtcaggatccccaattgtcgacaaaaaaggaaaggtcgtgggtctctatggcaatggtgtcgtcacaaggagtggaacatatgtgagtgccatagcccagactgaaaaaagcattgaagacaatccagagattgaagatgatatctttcggaaaaaaagattaaccatcatggacctccacccaggagcgggaaagacgaaaagataccttccagcaatagtcagagaggccataaaacgaggcttaagaacattaatcctggcccccaccagagtcgtggcagccgaaatggaagaagctcttagaggacttccaataagataccaaaccccagccattagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagccagaggatacatttcaactcgagtggagatgggtgaagcagctgggattttcatgacggccactcctccgggaagcagagacccatttcctcaaagcaatgcaccaatcatggatgaagaaagggaaatccctgaacgttcgtggaactctggacatgagtgggttacagattttaaagggaagactgtttggtttgttccgagtataaaagcaggaaatgatatagcagcttgcctgagaaaaaatggaaagaaagtgatacaactcagtaggaagacctttgattctgaatacatcaagaccaggaccaatgattgggattttgtggtcacgactgacatttcagaaatgggtgctaacttcaaggctgaaagggttatagaccccaggcgctgcatgaagccagtcatattgacagacggtgaagagcgggtgatcctggcaggacccatgccagtgactcactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaagtggatgccattgatggtgaataccgcttaagaggagaagcaaggaaaacctttgtggagctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggagaaaagaagaaactgaaacccagatggttggatgctaggatctactctgacccactggcgctcaaagaattcaaagagtttgcagctggaagaaaatccctgaccatgaatttaatcacagaaatgggtaggctcccaacttttatgactcagaaagcaaggaacgcattggacaacttagcagtcctgcatacagctgaagcaggcggaagggcgtacaatcatgctctcagtgaactgccagagaccctggagacattgcttttgctgacactcttggctacagtcacgggcggaatctttttatttttgatgagtggaaaaggcatagggaaaatgaccctgggaatgtgttgcataattacggccagcattctcctatggtacgcacaaatacagccacactggatagcagcttcaataatactggagttttttctcatagtcttgctcattccagagccagaaaagcaaagaacaccccaagacaaccaattgacttacgttgtcatagccatcctcacagtggtggccgcaaccatggcaaacgagatggggttcctggaaaaaacgaagaaagatttcggattgggaagcattgtagcccagcaacccgagagcaacattctggacatagatctacgtcctgcatcagcatggaccctgtatgcagtggccacaacatttatcacaccaatgttgagacatagcattgaaaattcctcagtgaatgtgtctctaacagccattgccaatcaagccacagtgctaatgggtcttgggaagggatggccattgtcaaaaatggacattggagttccccttctcgccatcgggtgctattcacaagtcaaccccataacccttacagcagcccttcttttattggtagcacactatgcaatcatagggccaggactccaagcaaaagcaaccagagaagcgcagaaaagagcagcagcaggcatcatgaaaatcccaactgtggatggaataacagtgattgacctagatccaataccctatgatccaaaatttgagaagcagctgggacaagtaatgctcctagtcctctgcgtgactcaagtattgatgatgaggactacatgggctttgtgtgaggctctaaccttagcgaccgggcccatctccacattgtgggaaggaaatccagggagattttggaacacaaccattgcagtgtcaatggctaacatttttagaggaagttacctagctggagccggacttctcttttccatcatgaagaacacaaccaacacaagaaggggaactggcaacacaggagagacgcttggggaaaaatggaaaaaccgattgaattcattggggaagagtgaattccagatttacaagagaagcggaatccaggaagtggatagaaccttggcaaaagaaggcattaaaagaggagaaacggaccatcacgctgtgtcgcgaggctcagcaaagctgagatggttcgtcgagagaaacctggttacaccagaggggaaagtaatggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactcccccagaaaagtgcgacacattgttgtgtgatataggggagtcgtcaccaaatcccacggttgaagcaggacgaacacttagagtcctaaacttggtagagaattggctgaacaacaacacccaattttgcataaaggttctaaacccatacatgccctcagtcatcgaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgatcaatagattcacaatgagacataagaaggccacatacgagccagatgttgacctcggaagcggaacccgcaacatcggaattgaaagtgaaacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgagacatgtgtgtacaacatgatgggaaagagagagaagaagataggagaattcggcagagcaaaaggcagcagagccatatggtacatgtggcttggagcacgcttcttagagtttgaagccctgggattcctgaatgaagatcactggttttccagagagaactctctgagcggagtggaaggagaagggctgcacaagctgggttacattctaagagaagtgagcaagaaagaaggaggagcaatgtacgccgacgacacagcaggatgggacacaagaatcacactagaggacttaaaaaatgaagaaatggtgacaaaccatatggaaggagaacacaagaaacttgccgaggccattttcaagttaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagaaggagtctttaaaagcatccagcatctgacaaccacagaagaagtagcagtgcaagactggttagcaagagtggggcgtgagaggttatcgagaatggccatcagtggagatgattgtgttgtgaaacccttagatgacaggtttgcaagcgctttaacagctctaaacgacatgggaaaggttaggaaagacatacaacaatgggaaccttcaaaaggatggaacgactggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcggctaacgctatttgctcggcagtcccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagagccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 6422 - RNA, 9876 nt, synthetic construct
  misc_feature 1..9876: note = derived and/or modified CDS sequence (wt) from DENV-2__KX380829__SS-prME
  source 1..9876: mol_type = other RNA
actgcaggcgtgatcatcatgctaattccaacagcgatggcgttccatttaaccacacgcaacggagaaccacacatgatcgtcagcagacaagagaaagggaaaagtctcttgttcaaaacagaggatggtgtgaacatgtgtaccctcatggccatggaccttggtgaactgtgtgaagacacaatcacttataactgtcctcttctcaggcagaatgaaccagaagatatagattgttggtgtaactccacgtccacatgggtaacttatgggacatgcactgccacaggagaacacagaagggaaaaaagatcagtggcactcgtcccacatgtgggaatgggattggagacacgaactgaaacatggatgtcatcagaaggggcctggaaacacgcccagagaattgaaacctggatcttgagacatccaggttttaccataatggcagcaatcttggcatacaccataggaacgacatacttccaaagagtcctaatcttcatcttactgacagccgtcgccccttcaatgacaatgcgttgtattggaatatcaaatagagactttgtggaaggggtttcaggaggaagctgggttgacatagtcctagaacatggaagctgcgtgacaacgatggcaaaaaacaaaccaacattggactttgaactgataaaaacagaagccaagcaacctgccactctaaggaagtactgtatagaagcaaagctgaccaacacaacaacagcatctcgatgcccaacacaaggagaacccagcctaaatgaagaacaggacaaaaggtttgtctgcaaacattccatggtagacagaggatggggaaatggatgtggattatttggaaagggaggcatcgtgacctgtgctatgttcacatgcaaaaaaaacatggaaggaaaaattgtgcaaccagaaaacctggaatacaccattgtggtaacacctcattcaggggaagagaatgcagttggaaatgacacaggaaaacatggcaaggaaatcaaagtaacaccacagagttccattacagaagcagaactgacaggctacggcactgtcacgatggagtgctctccaagaacgggcctcgacttcaatgaaatggtgttgctgcaaatggaaaataaggcttggctggtgcacaggcaatggttcttagacctgccgttaccatggttgcccggagcggacacacaaggatcaaattggatacagaaggagatgttggtcaccttcaaaaacccccatgcgaagaaacaggatgttgttgttttaggatcccaagaaggggctatgcatacagcacttacaggggccacggaaatccagatgtcgtcaggaaacctactgttcacaggacatcttaagtgcaggctgagaatggataaattacagctcaaaggaatgtcatactctatgtgtacaggaaagtttaaagttgtaaaagaaatagcagaaacacaacatggaacaatagttgtcagagtacaatatgaaggggatggctctccatgtaagatcccttttgagataatggatttggaaaaaagacatgtcttaggtcgcctgattacagtcaacccaatcgtaacagaaaaagacagtccagtcaacatagaagcagaacctccatttggagacagctacatcattataggagtagaaccgggacaactgaagctcagctggtttaagaaaggaagctcaatcggccaaatgttcgagacaacaatgagaggagcgaagagaatggccattttaggtgacacagcctgggattttggatccctgggaggagtattcacatctataggaaaggccctccaccaagtttttggagcaatctatggggctgccttcagtggggtctcatggactatgaaaatcctcataggagttgtcatcacatggataggaatgaattcacgtagcacctcactgtctgtgtcactagtattagtgggagtcgtgacattgtatttgggagttatggtgcaggctgatagtggttgtgttgtgagttggaaaaacaaagaactgaaatgtggcagtgggatttttatcacagacaatgtacacacatggacagaacaatacaaattccaaccagaatccccctcaaagctggcttcagctatccagaaagctcatgaagagggcatttgtggaatccgctcagtaacaagactagagaatctaatgtggaaacaaataacacccgaattgaatcacattctatcagaaaatgaggtaaagttgaccatcatgacaggagacatcaaaggtatcatgcaggcaggaaaacgatccctgcggcctcagcccactgagctgaagtattcatggaaaacgtggggcaaagcgaaaatgctctccacagagcctcataaccagacctttctcattgatggccccgaaacagcagaatgtcccaacacaaacagagcttggaactcactagaagttgaagactatggctttggggtgttcaccaccaacatatggctgaagttgaaagaaaggcaggatgtgttttgcgactcaaagctcatgtcagcggccataaaagacaacagagccgtccatgccgatatgggttattggatagaaagcgcacttaatgacacatggaagatagaaaaagcttcttttattgaagtcaaaagttgccactggccaaaatcacacactctctggagcaatggagtgctagaaagtgagatgataattccaaagaattttgctggaccagtatcacaacataattacagaccaggctatcacacacaaacggcaggaccctggcatctaggcaagcttgagatggactttgatttttgcgaaggaaccacagtggtggtgactgaggactgtggaaatagaggaccctctctaagaacaactaccgcctctggaaaactcataacagaatggtgctgccgatcctgcacattaccaccactaagatacaaaggtgaggatggatgctggtacggaatggaaatcagaccattgaaagagaaagaagagaacttggtcaactccttggtcacagccggacatggacagattgacaacttctcactaggggtcttgggaatggcactgttcctggaagaaatgctcaggacccgagtaggaacaaagcatgcagtattactagttgcagtttctttcatgacactgatcacagggaacatgtctttccgagacctggggagagtgatggtcatggtgggggctgctatgacggatgacataggtatgggcgtgacttatcttgccttactagcagccttcaaagttagaccaacttttgcagctggactgcttttgagaaagctgacctccaaggaattgatgatgaccaccataggaattgtactcctctcccagagcaccataccagagaccatacttgaactgactgacgcgttggccttgggcatgatgattctcaagatagtgaggaatatggaaaagtatcaattagcagtgactatcatggctatcttatgtgctccaaatgcagtgatattacaaaatgcatggaaagtgagctgcacaatactggcagtggtgtccgtatccccactgctcttaacatcttcacagcagaaagcggattggataccattggcattgacgatcaaaggtctcaatccaacagccattttcctaacaaccctttcaagaaccaacaagaaaaggagttggccactaaatgaggctatcatggcagtagggatggtgagcattttagccagttctctcttgaagaatgacattcccatgacaggaccattagtggctggagggcttctcactgtgtgttacgtgctcactggaagatcggccgacttggaactggagagagccgccgacgtaagatgggaagatcaggcagagatatcaggaagcagtccaattctgtcaataacaatatcggaagatggcagcatgtcgataaaaaatgaagaggaagaacaaacactgaccatactcattagaacaggattgctggtgatatcaggactttttcccgtatcaataccaattacggcagcagcatggtacctgtgggaagtgaagaaacaacgggctggagtattgtgggatgttccttcacccccacctgtgggaaaggccgaactggaagatggagcttatagaatcaagcagaaagggattcttggatactcccagatcggagctggagtttacaaagaaggaacattccacacaatgtggcacgtcacacgtggtgctgttctaatgcataaagggaagagaattgaaccatcatgggcggatgtcaggaaagacctaatatcgtatggaggaggctggaagctagaaggagaatggaaggaaggagaagaagtccaggtcttggcattagagcctggaaagaatccaagagccgtccaaacaaaacccggtcttttcaaaactaacaccggaaccataggtgctgtgtctctagacttttctcctggaacgtcaggatccccaattgtcgacaaaaaaggaaaggtcgtgggtctctatggcaatggtgtcgtcacaaggagtggaacatatgtgagtgccatagcccagactgaaaaaagcattgaagacaatccagagattgaagatgatatctttcggaaaaaaagattaaccatcatggacctccacccaggagcgggaaagacgaaaagataccttccagcaatagtcagagaggccataaaacgaggcttaagaacattaatcctggcccccaccagagtcgtggcagccgaaatggaagaagctcttagaggacttccaataagataccaaaccccagccattagagctgagcacactgggcgagaaatcgtggatttaatgtgtcatgccacatttaccatgaggctgttatcaccagttagagtgccaaattacaacttgatcattatggatgaagcccatttcacagacccagcaagcatagcagccagaggatacatttcaactcgagtggagatgggtgaagcagctgggattttcatgacggccactcctccgggaagcagagacccatttcctcaaagcaatgcaccaatcatggatgaagaaagggaaatccctgaacgttcgtggaactctggacatgagtgggttacagattttaaagggaagactgtttggtttgttccgagtataaaagcaggaaatgatatagcagcttgcctgagaaaaaatggaaagaaagtgatacaactcagtaggaagacctttgattctgaatacatcaagaccaggaccaatgattgggattttgtggtcacgactgacatttcagaaatgggtgctaacttcaaggctgaaagggttatagaccccaggcgctgcatgaagccagtcatattgacagacggtgaagagcgggtgatcctggcaggacccatgccagtgactcactctagtgcagcacaaagaagagggagaataggaagaaatccaaaaaatgaaaatgaccagtacatatacatgggggaacctctggaaaatgatgaagactgcgcacactggaaagaagccaagatgcttttagacaacatcaacacgcctgaaggaatcattcccagcatgttcgaaccagagcgtgaaaaagtggatgccattgatggtgaataccgcttaagaggagaagcaaggaaaacctttgtggagctaatgagaagaggagacctaccagtctggctggcctacagagtggcagccgaaggcattaactatgcagacagaaggtggtgttttgatggaatcaagaacaaccaaatcttggaagaaaatgtggaagtggaaatctggacaaaagaaggagaaaagaagaaactgaaacccagatggttggatgctaggatctactctgacccactggcgctcaaagaattcaaagagtttgcagctggaagaaaatccctgaccatgaatttaatcacagaaatgggtaggctcccaacttttatgactcagaaagcaaggaacgcattggacaacttagcagtcctgcatacagctgaagcaggcggaagggcgtacaatcatgctctcagtgaactgccagagaccctggagacattgcttttgctgacactcttggctacagtcacgggcggaatctttttatttttgatgagtggaaaaggcatagggaaaatgaccctgggaatgtgttgcataattacggccagcattctcctatggtacgcacaaatacagccacactggatagcagcttcaataatactggagttttttctcatagtcttgctcattccagagccagaaaagcaaagaacaccccaagacaaccaattgacttacgttgtcatagccatcctcacagtggtggccgcaaccatggcaaacgagatggggttcctggaaaaaacgaagaaagatttcggattgggaagcattgtagcccagcaacccgagagcaacattctggacatagatctacgtcctgcatcagcatggaccctgtatgcagtggccacaacatttatcacaccaatgttgagacatagcattgaaaattcctcagtgaatgtgtctctaacagccattgccaatcaagccacagtgctaatgggtcttgggaagggatggccattgtcaaaaatggacattggagttccccttctcgccatcgggtgctattcacaagtcaaccccataacccttacagcagcccttcttttattggtagcacactatgcaatcatagggccaggactccaagcaaaagcaaccagagaagcgcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttgtgtgaggctctaaccttagcgaccgggcccatctccacattgtgggaaggaaatccagggagattttggaacacaaccattgcagtgtcaatggctaacatttttagaggaagttacctagctggagccggacttctcttttccatcatgaagaacacaaccaacacaagaaggggaactggcaacacaggagagacgcttggggaaaaatggaaaaaccgattgaattcattggggaagagtgaattccagatttacaagagaagcggaatccaggaagtggatagaaccttggcaaaagaaggcattaaaagaggagaaacggaccatcacgctgtgtcgcgaggctcagcaaagctgagatggttcgtcgagagaaacctggttacaccagaggggaaagtaatggacctcggttgcggtagagggggctggtcatactattgtgggggtctaaagaatgtaagagaagtcaaaggcctaacaaaaggaggaccaggacacgaagaacccattcccatgtcaacatatgggtggaatcttgtgcgtctccaaagtggagttgatgttttctttactcccccagaaaagtgcgacacattgttgtgtgatataggggagtcgtcaccaaatcccacggttgaagcaggacgaacacttagagtcctaaacttggtagagaattggctgaacaacaacacccaattttgcataaaggttctaaacccatacatgccctcagtcatcgaaaaaatggaaacgctgcaaaggaaatacggaggagctttggtgaggaatccactctcaagaaattccacacatgagatgtattgggtatccaatgcttccgggaacatagtgtcatcagtgaacatgatttcaaggatgttgatcaatagattcacaatgagacataagaaggccacatacgagccagatgttgacctcggaagcggaacccgcaacatcggaattgaaagtgaaacaccaaacctagacataattgggaaaagaatagaaaaaataaaacaagagcatgagacatcatggcactatgaccaagaccacccatataaaacgtgggcctaccatggcagctacgaaacaaaacagactggatcagcatcatccatggtgaatggagtagttagactgctgacaaaaccttgggacgtcatccctatggtgacacagatggcaatgacagacacgaccccatttggacaacagcgtgttttcaaagagaaagtggacacgagaacccaagaaccgaaagaaggcacgaagaaactaatgaaaatcacggccgaatggctctggaaagaactaggaaagaaaaagacacctagaatgtgcaccagagaagaattcacaagaaaggtgagaagcaatgcagccctaggtgccatattcactgatgagaacaagtggaagtcggcacgtgaggctgttgaagacagtagattttgggaactggttgacaaggaaaggaatctccatcttgaaggaaagtgtgagacatgtgtgtacaacatgatgggaaagagagagaagaagataggagaattcggcagagcaaaaggcagcagagccatatggtacatgtggcttggagcacgcttcttagagtttgaagccctgggattcctgaatgaagatcactggttttccagagagaactctctgagcggagtggaaggagaagggctgcacaagctgggttacattctaagagaagtgagcaagaaagaaggaggagcaatgtacgccgacgacacagcaggatgggacacaagaatcacactagaggacttaaaaaatgaagaaatggtgacaaaccatatggaaggagaacacaagaaacttgccgaggccattttcaagttaacgtaccaaaacaaggtggtgcgtgtgcaaagacccacaccaagaggcacagtaatggatattatatcgagaagagaccaaagaggtagtggacaagttggcacctatggcctcaacacctttaccaatatgggagcccaactaatcagacagatggagggagaaggagtctttaaaagcatccagcatctgacaaccacagaagaagtagcagtgcaagactggttagcaagagtggggcgtgagaggttatcgagaatggccatcagtggagatgattgtgttgtgaaacccttagatgacaggtttgcaagcgctttaacagctctaaacgacatgggaaaggttaggaaagacatacaacaatgggaaccttcaaaaggatggaacgattggacacaagtgcctttctgttcacaccatttccatgagttaatcatgaaagacggtcgtgtgctcgtagttccatgtagaaaccaagatgaactgattggtagagctcgaatttcccagggagccgggtggtctttgcgggagacggcctgtctggggaagtcttacgcccaaatgtggagcctgatgtacttccacagacgtgacctcaggctggcggctaacgctatttgctcggcagtcccatcacattgggttccaacaagtcgaacaacctggtccatacacgccagacatgaatggatgacaacagaagacatgctgacagtctggaacagggtgtggattcaagaaaacccatggatggaagacaaaactccagtggaatcatgggaggaaatcccatacttggggaaaagagaagaccaatggtgcggctcattgatagggttaacaagcagagccacctgggcaaagaacatccaaacagcaataaaccaagttagatccttaataggcagtgaggaatacacagactatatgccatccatgaaaagattcagaagagaagaggaagaggcaggggtcttgtggtag

SEQ ID NO: 6423 - RNA, 9876 nt, synthetic construct
  misc_feature 1..9876: note = derived and/or modified CDS sequence (wt) from DENV-2__KX380830__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggagacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgtagtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagatatcttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatcactgaccttgaatctaatcaccgagatgggtaggctcccaaccttcatgacccagaaagcaagaaatgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctactcacaagtcaaccccataactctcacagcagcccttctcttattggtagcacactatgctatcatagggccaggactccaagcgaaagcaactagagaggctcagaaaagagcagcagcgggtatcatgaaaatcccagctgccgatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6424 - RNA, 9876 nt, synthetic construct
  misc_feature 1..9876: note = derived and/or modified CDS sequence (wt) from DENV-2__KX380831__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaacctcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaagaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggcgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagctacctggccggggccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacacgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6425 - RNA, 9876 nt, synthetic construct
  misc_feature 1..9876: note = derived and/or modified CDS sequence (wt) from DENV-2__KX380808__SS-prME
  source 1..9876: mol_type = other RNA
actgcaggtataattattatgatgatcccaacagtgatggcgttccatttaaccacacgcaatggagaaccacacatgatcgtcagtagacaagagaaagggaaaagtcttctgtttaaaacagagaacggtgtgaacatgtgcaccctcatggccatggaccttggtgaactgtgtgaagacacaatcacttacaattgtcctcttctcaagcagaatgagccagaagacatagactgttggtgcaactctacgtctacatgggtaacttatgggacatgcacagccacaggagaacacagaagggaaaaaagatcagtggcactcgttccacatgtgggaatgggactggagacacgaactgaaacatggatgtcatcagaaggggcctggaaacatgcacagagaattgagacctgggtcttgagacatccaggcttcaccataatggcagcaatcctggcatacaccataggaacgacatatttccaaagagtcctgattttcatcttactgacagctatcgctccttcaatgacaatgcgttgtataggaatatcaaatagagactttgtggaaggggtttcaggaggaagctgggttgacatagtcttggaacatggaagctgtgtgacgacgatggcgaaaaataaaccaacactggattttgaactgattaagacagaagccaaacatcccgccactctaaggaagtattgtatagaggcaaaactgaccaacacaacaacagcatctcgctgcccaacacaaggagaacctagcctaaatgaagaacaggacaaaagatttgtctgcaaacactccatggtagacagaggatgggggaatggatgcggattatttggaaaaggaggtatcgtgacctgtgcaatgttcacatgcaagaagaacatggaaggaaaaatcgtgcaaccagaaaacttggagtacaccattgtgataacacctcactcaggggaagagaatgcagttggaaatgacacaggaaaacacggcaaggaaattaaagtaacaccacagagttccatcacagaagcagaactaacaggctatggcactgtcacgatggaatgctctccgagaacgggactcgacttcaatgagatggtgttgctgcaaatggaaaacaaggcttggctggtgcacaggcaatggttcttagacctgccattaccatggctgcccggagcagacacacaaggatcaaattggatacagaaggagacattggtcactttcaaaaatccccatgcaaagaaacaggatgttgttgttttaggatcccaagaaggggctatgcacacagcactcacaggggccacggaaatccagatgtcatcaggaaacttactattcacaggacatcttaaatgtaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaagatcccttttgaaataatggatttggaaaaaagacatgtcttaggtcgcttgattacagtcaacccaattgtcacagaaaaagacagcccagtcaacatagaagcagaacctccattcggagacagctatatcattataggagtagaaccgggacaactgaagctcagctggttcaagaaaggaagttctattggccaaatgtttgagacaacaatgagaggagcgaagagaatggccattttaggtgacacagcttgggattttggatccctgggaggagtgttcacatctataggaaaggccctccaccaagtctttggagcaatctatggggctgccttcagtggggtttcatggactatgaaaattctcataggagtcgtcatcacatggataggaatgaattcacgtagcacctcactgtctgtgtcactagtattagtgggagtcgtgacattgtatttgggagttatggtgcaggccgatagcggttgcgttgtgagctggaaaaacaaagaactgaaatgtggcagtgggatttttatcacagacaacgtgcacacatggacagaacaatacaaattccaaccagaatccccttcaaagctggcttcagctatccagaaggctcatgaagaaggcatttgtggaatccgttcagtaacaagactggagaatctgatgtggaaacaaataacaccagaactgaatcacattctatcagaaaatgaggtgaagttgaccatcatgacaggagacattaaaggaatcatgcaggcaggaaaacgatccctgcggcctcaacccactgagctgaagtactcttggaaagcatggggcaaagcgaaaatgctctccacagagcttcataaccacacctttctcattgatggccccgaaacagcagaatgtcccaacacaaacagagcttggaactcactagaggttgaagattatggctttggagtgttcaccactaacatatggctgaaattgaaagaaaggcaggatgtattttgtgactcaaaactcatgtcggcagccataaaagacaacagagccgtccacgccgacatgggttattggatagaaagcgcactaaatgacacatggaagattgagaaagcctcttttattgaaattaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgatttctgcgaaggaactacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgtttctggaagagatgcttagaacccgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagccttcaaggtcagaccaacctttgcagctggactactcttaagaaagctgacctccaaggaattgatgatgaccaccataggaatcgtactcctctctcagagcaccataccagagaccatacttgaactgactgacgcgttggctttggggatgatggttctcaaaatagtaagaaacatggaaaagtatcaactagcagtgactatcatggctatcttgtgcgtcccaaatgcagtgatattacaaaacgcatggaaagtgagctgcacaacactggcagtggtgtccgtttccccactgcttttaacatcctcacagcagaaagcggattggataccactggcgttgacgatcaaaggcctcaatccaacagccattttcttaacaaccctctcaagaactagcaagaaaaggagctggccactaaatgaggctatcatggcagtagggatggtgagcattttagccagttctctcttaaagaatgacattcccatgacaggaccactagtggctggagggcttctcactgtgtgttacgtgctcactggaagatcggctgatttggaactggagagggctgctgacgtaagatgggaagaacaggcagagatatcaggaagcagtccaattctgtcgataacaatatcggaagatggtagcatgtcgataaaaaatgaagaagaagaacaaacactgaccatactgattagaacaggactgctggtgatatcaggactgtttcccgtgtcaataccaatcacggcagctgcatggtacctgtgggaagtgaaaaagcaacgagccggagtattgtgggatgtcccttcacctccacctgtgggaaaggccgaactggaagatggagcctatagaatcaagcagaaagggattctaggatactcgcagataggagccggagtctacaaagaaggaacattccacacaatgtggcatgtcacacgtggtgctgttctaatgcataaagggaagagaattgaaccatcatgggcggacgtcaagaaagacctaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtggaacatatgtgagtgccatagcccagactgaaaaaagcattgaagacaacccagagattgaagatgacatctttcgaaagaaaagattgaccatcatggacctccacccaggagcaggaaagacaaagagatatcttccagcaatagtcagagaagccataaaacgaggcttgagaacactaatcctggcccccactagagttgtggcggctgaaatggaagaagctctcagaggacttccaataagataccaaaccccagctattagagctgaacacactggacgggagattgtggatctaatgtgtcacgccacatttaccatgaggctactatcaccaattagagtgccaaattacaacctgattatcatggatgaagcccatttcacagacccagcaagcatagcagctagaggatacatttcaactcgagtagagatgggtgaagcagctgggattttcatgacagctacccctcctggaagcagagacccatttcctcagagcaacgcaccaatcatggatgaagaaagggaaatccctgagcgttcgtggaactcaggacatgagtgggttacggattttaaagggaagactgtttggtttgttccaagtataaaagcaggaaatgatatagcagcttgcctgagaaagaatggaaagaaagtgatacaactcagcaggaagacttttgatactgaatatatcaagactaggaccaatgattgggactttgtggtcacgacagacatttcagaaatgggtgctaacttcaaggctgagagggttatagaccccagacgctgcatgaaaccagtcatactaacagacggcgaagagcgggtgatcctggcaggacccatgccagtgacccactctagtgcagcacagagaagagggagagtaggaagaaatccaaaaaatgaaaatgaccagtacatatacatgggggaacctctggaaaatgatgaagactgcgcacactggaaagaagctaagatgcttctagataacatcaacacgcctgaaggaatcattcccagcatgtttgaaccagagcgtgaaaaggtcgacgccattgatggtgaataccgcttgagaggagaagcgaggaaaacatttgtggacctaatgagaagaggggacctaccagtttggctagcctacagagtggcagctgaaggtatcaactacgcagacagaagatggtgctttgatggagtcaagaacaaccaaatcttggaagaaaatgtggaggtggaaatttggacaaaagaaggagaaaggaagaaattaaaacccagatggttagatgctaggatctactctgatccactggcgctcaaagaattcaaggaattcgcagctggaaggaaatccctgaccctgaatctaattaccgaaatgggtaggctcccaaccttcatgacccagaaagcaaggaatgcattggacaacttagcagtcctacatacggctgaagcaggcggaagggcgtataatcatgctcttagtgaactgccagagactctggagacattgcttttactgacacttttggccacagtcacgggcggaatcttcctgttcttgatgagcggaaaaggtatagggaagatgaccctgggaatgtgctgcataatcacagccagtattctcctatggtatgcacaaatacagccacattggatagcagcttcaataatactggagttttttctcatagtcttgctcattccagagccagaaaagcagagaacaccccaagataaccaattaacttatgttgtcatagccatccttacagtggtggccgcaaccatggcaaacgagatgggtttcctggaaaaaacaaagaaagatttcggattgggaagcattacaacccagcaacctgagagcaacatcctggacatagatctgcgtcctgcatcagcctggactctatatgccgtggcaacaactttcatcacaccaatgttgagacatagcattgaaaattcctcagtgaatgtgtctctaacagccatcgccaaccaagccacagtgttaatgggtcttgggaaaggatggccattgtcgaaaatggacatcggagttccccttctcgctattggatgctattcacaagtcaaccccataaccctcacagcagcccttctcttattggtaacacattatgctatcatagggccaggactccaagcgaaagcaactagagaggctcagaaaagagcagcagcgggcatcatgaaaatcccaactgtggatggaataacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaacacaactattgcagtgtcaatggctaacatttttagagggagttacctggccggagccggacttctcttttctatcatgaagaacacggccaacacaagaaggggaactggcaacacaggagagacgcttggagagaaatggaaaaaccggttgaatgcattggggaagagtgaattccagatctataagaaaagtggaatccaggaagtggatagaactttagcaaaagaaggcatcaagagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtctccaaagtggagtcgatgtcttttttactccgccagaaaagtgtgacacattgctgtgtgacataggggagtcgtcaccaaaccccacggttgaggcaggacgaacactcagagttctaaacttagtggaaaactggctgaacaacaacacccaattttgcataaaggttcttaacccatatatgccttcagttatagaaaaaatggaagcgctacaaaggaaatacggaggagctttggtgaggaatccactctcacgaaattccacacacgagatgtactgggtttccaatgcttccgggaacatagtgtcatcagtgaacatgatttcaagaatgttgattaacagattcacaatgagacacaagaaggccacatacgagccggatgttgatctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccaaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattctgggaattggttgacaaggaaaggaatctccatcttgaaggaaagtgtgagacatgtgtgtataacatgatgggaaagagagagaagaagctaggggagttcggcaaagcaaaaggcagcagagccatatggtacatgtggcttggagcacgcttcttagagtttgaagccctaggtttcttgaatgaagatcactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggatttgaaaaatgaagaaatggtgacaaatcacatggaaggagaacacaagaaacttgctgaagccattttcagattaacgtaccaaaataaagtagtgcgtgtgcaaagaccgacaccaagaggcacagtaatggacattatatcgagaagagaccaaagaggtagtggacaagttgtcacctacggcctcaatactttcaccaacatggaagctcaactgatcagacagatggagggagaaggactcttcaaaagcatccagcatctgacagtcacagaagaaattgcagtgaaaaactggttagtaagagtggggcgtgagaggttatcaagaatggccatcagcggagacgattgtgttgtgaaacccttagatgacaggtttgcaagcgctctaacagctctaaatgacatgggaaaggtcaggaaagacatacaacaatgggaaccttcaagaggatggaacgattggacacaagtgcccttttgttcacaccatttccatgagttaatcatgaaggacggtcgtgtacttgtggttccatgtagaaaccaagatgaactgattggtagggcccgaatttcccagggagccgggtggtccttgcgggaaacagcctgtttggggaagtcttacgcccaaatgtggagcctaatgtacttccacagacgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggatccaagaaaacccatggatggaagacaaaactccagtagaatcatgggaggaaatcccatatttggggaagagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtag

SEQ ID NO: 6426 - RNA, 9876 nt, synthetic construct
  misc_feature 1..9876: note = derived and/or modified CDS sequence (wt) from DENV-2__KX380832__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatgactatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcattagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaggcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatataacagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcaaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaatgcattggacaacttagcagtcctgcatacggctgaagcaggcggaagggcgtacaaccatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctattcacaagtcaaccccataactctcacagcagcccttctcttattggtagcacactatgctatcatagggccaggactccaagcgaaagcaactagagaggctcagaaaagagcagcagcgggtatcatgaaaatcccagctgccgatggaataacagtgattgacctagatccaataccctatgatccaaagtttgagaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaacaagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggtaatgaggaatacacagactacatgccatccatgaaaagattcagaagagaagaggaagaggcaggagtcttgtggtaa

SEQ ID NO: 6427 - RNA, 9876 nt, synthetic construct
  misc_feature 1..9876: note = derived and/or modified CDS sequence (wt) from DENV-2__KX380833__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatcactgaccttgaatctaatcaccgagatgggtaggctcccaaccttcatgacccagaaagcaagaaatgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctactcacaagtcaaccccataactctcacagcagcccttctcttattggtagcacactatgctatcatagggccaggactccaagcgaaagcaactagagaggctcagaaaagagcagcagcgggtatcatgaaaatcccagctgccgatggaataacagtgattgacctagatccaataccctatgatccaaagtttgagaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6428 - RNA, 9876 nt, synthetic construct
  misc_feature 1..9876: note = derived and/or modified CDS sequence (wt) from DENV-2__KX380834__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaacctcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaggcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagctacctggccggggccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacacttagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaatgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6429 - RNA, 9876 nt, synthetic construct
  misc_feature 1..9876: note = derived and/or modified CDS sequence (wt) from DENV-2__KX380835__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagttctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgggtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatcactgaccttgaatctaatcaccgagatgggtaggctcccaaccttcatgacccagaaagcaagaaatgcattggacaacttagcagtcctgcatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctactcacaagtcaaccccataactctcacagcagcccttctcttattggtagcacactatgctatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6430 - RNA, 9876 nt, synthetic construct
  misc_feature 1..9876: note = derived and/or modified CDS sequence (wt) from DENV-2__KX380836__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctatcctgtgcgtcccaaatgcagtgatattacaaaacgcatggaaagtgagctgcacgatactggcagtggtgtccgtttccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctatcttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttaggctggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6431 - RNA, 9876 nt, synthetic construct
  misc_feature 1..9876: note = derived and/or modified CDS sequence (wt) from DENV-2__KX380838__SS-prME
  source 1..9876: mol_type = other RNA
actgcaggtataattattatgatgattccaacagtgatggcgttccatttaaccacacgcaatggagaaccacacatgatcgtcagtagacaagaaaaagggaaaagtcttctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactctacgtctacatgggtaacttatgggacatgcaccgctacaggagaacacagaagggaaaaaagatcagtggcactcgttccgcacgtgggaatgggactggagacacgaactgaaacatggatgtcatcagaaggggcctggaaacatgcgcagagaattgaaacttgggtcttgagacatccaggcttcactgtaatggcagcaatcctggcatacaccataggaacgacatatttccaaagagtcctgattttcatcttactgacagctgtcgctccttcaatgacaatgcgttgtataggaatatcaaatagagactttgtggaaggggtttcaggaggaagctgggttgacatagtcttggaacatggaagctgtgtgacaacgatggcgaaaaataaaccaacattggattttgaactgataaaaacagaagccaaacatcccgccactctaaggaagtattgtatagaggcaaagctgaccaacacaacaacagcatctcgctgcccaacacaaggagaacctagcctaaatgaagaacaggacaaaagatttgtctgcaaacactccatggtagacagaggatggggaaatggatgcggattatttggaaagggaggtatcgtgacctgtgcaatgttcacatgcaaaaagaacatggaaggaaaaatcgtgcaaccagaaaatttggaatacaccattgtgataacacctcactcaggggaagagaatgcagtcggaaatgatacaggaaaacacggcaaggaaattaaagtgacaccacagagctccatcacagaagcagaactaaccggctatggcactgccacgatggaatgctctccgagaacgggcctcgacttcaatgagatggtgttgctgcaaatggaaaacaaggcttggctagtgcacaggcaatggttcttagacctgccgttaccatggctgcccggagcagacacacaaggatcaaattggatacagaaggagacattggtcactttcaaaaatccccatgcaaagaaacaggatgttgttgtgttaggatcccaagaaggggctatgcacacagcactcacaggggccacggaaatccagatgtcatcaggaaacttactgttcacaggacatcttaaatgcaggctgagaatggacaaactacagctcaaaggaatgtcatattccatgtgtacaggaaagttcaaagttgtgaaggaaatagcagaaacacaacatggaacaatagttatcagagtacaatatgaaggggacggttctccgtgcaaaatcccttttgaaataatggatttggaaaaaagacatgtcttaggtcgcttgatcacagtcaacccaattgtcacagaaaaagacagcccagtcaacatagaagcagaacctccattcggagacagctacatcattataggagtagaaccggggcaactgaagctcagctggtttaagaaaggaagttctattggccaaatgtttgagacaacaatgagaggagcgaagagaatggccattttaggtgacacagcttgggattttggatctctgggaggagtgtttacatctataggaaaggccctccaccaagtctttggagcaatctatggggctgccttcagtggggtttcatggactatgaaaatcctcataggagttgtcatcacatggataggaatgaattcacgcagcacctcactgtctgtgtcactagtattagtgggaatcgtgacactgtatttgggagttatggtgcaggctgatagtggctgcgttgtgagctggaaaaacaaagaactgaaatgtggcagtgggatctttatcacagacaacgtgcacacatggacagaacaatacaaattccaaccagaatccccttcaaaactggcttcagctatccagaaggcccatgaagagggcatttgtggaatccgctcagtaacaagactggagaatctgatgtggaaacaaataacaccagaactgaatcacattctatcagaaaatgaggtaaagttgactatcatgacaggagacattaaaggaatcatgcaggcaggaaaacgatccctgcgacctcaacccactgagctgaagtactcttggaaagcatggggcaaagcgaaaatgctctccacagagctccacaaccacacctttctcattgatggccccgaaacagcagaatgtcccaacacaaacagagcttggaactcactagaagttgaagactatggctttggagtattcactaccaacatatggctgaaattgaaagaaaggcaggatgtattttgtgactcaaaactcatgtcagcagccataaaagacaacagagccgtccacgccgatatgggttattggatagaaagcgcactcaacgacacatggaagattgagaaagcctcttttattgaagttaaaagctgccactggccaaagtcacacactctctggagcaatggagtgctagaaagtgagatgataattccaaagaattttgcaggaccagtgtcacaacacaattacagaccaggctatcatacacaaacggcaggaccctggcatctaggcaggcttgagatggactttgacttctgcgaaggaaccacagtggtggtgactgaggactgtggaaatagaggaccctctttaagaacaactactgcttctggaaaactcataacagaatggtgctgccgatcttgcacattaccaccgctaaggtacagaggtgaggatggatgctggtatggaatggaaatcagaccattgaaagagaaagaagagaacttggtcaactctttggtcacagccggacatggacagattgacaacttctcactaggagtcttgggaatggcattgttcctggaagagatgctcaggactcgagtaggaacgaaacatgcaatattattagttgcagtctctttcgtgacattgatcacagggaacatgtcctttcgagatttggggagagtgatggtcatggtgggcgctactatgacggatgacataggcatgggcgtgacttatcttgccctattagcagccttcaaagtcagaccaacttttgcagctggactactcttaagaaagctgacctccaaggaattgatgatgaccaccataggaattgtactcctctctcagagcaccataccagagactatacttgaactgactgacgcgttggctttggggatgatggttctcaaaatagtaagaaacatggaaaagtatcaactagcagtgactatcatggctaccctgtgcgtcccaaatgcagtgatattacaaaacgcatggaaagtgagctgcacgatactggcagtggtgtccgtctccccactgcttttaacatcctcacagcagaaagcggattggataccactggcgttgacaatcaaaggcctcaatccaacagccattttcttaacaaccctctcaagaactagcaagaaaaggagctggccactaaatgaggctattatggcagtcgggatggtgagcattttagccagttctctcttaaagaatgatattcccatgacaggaccattagtggctggagggcttctcactgtgtgttacgtgctcactggaagatcggctgatttggaactggaaagagctgctgacgtaagatgggaggaacaggcagagatatcagggagcagtccaattctgtcgataacaatatcggaagatggtagtatgtcgataaaaaatgaagaagaagaacaaacactgaccatacttattagaacaggactgctggtgatatcaggactttttcccgtgtcaataccaatcacggcagctgcatggtacctgtgggaagtgaaaaaacaacgagccggagtattgtgggacgtcccttcacctccacctgtgggaaaagccgaactggaagatggagcctatagaatcaagcagaaagggattttaggatactcgcagattggagccggagtttacaaagaaggaacattccacacaatgtggcatgtcacacgtggtgctgttctaatgcacaaagggaagaggattgaaccatcatgggcggacgtcaagaaagacttaatatcgtatggaggaggctggaagctagaaggagaatggaaggaaggagaagaagtccaggtcctggcactagagcctggaaagaatccaagagccgtccaaacaaaacccggtctttttaaaactaacactggaaccataggcgccgtatctctggacttttctcctggaacgtcaggatctccaattgtcgacaaaaaaggaaaagttgtgggcctttatggcaacggtgtcgtcacaaggagtgggacatatgtgagcgccatagcccagactgaaaaaagcatcgaagacaatccagagattgaagatgacatctttcgaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactggacgggagattgtggatctaatgtgtcacgccacattcaccatgaggctactatcaccaatcagagtgccaaattacaacctgattatcatggatgaagcccattttacagacccagcaagcatagcagctagaggatacatttcaactcgagtagagatgggtgaagcagctgggattttcatgacagccacccctcctggaagcagagacccatttcctcagagcaacgcaccaatcatggatgaagaaagggaaatccctgagcgttcgtggaactctggacatgagtgggttacggattttaaagggaagactgtttggtttgttccaagtataaaagcaggaaatgatatagcagcttgcctgagaaagaatggaaagaaagtgatacaactcagcaggaagacctttgattctgaatatatcaagactaggaccaatgattgggactttgtggtcacgacagacatttcagaaatgggtgccaacttcaaggctgagagggttatagaccccagacgctgcatgaaaccagtcatactaacagacggtgaagagcgagtgatcttggcaggacccatgccagtgacccactctagtgcagcacaaagaagagggagagtaggaagaaatccaaaaaatgaaaatgaccagtacatatacatgggggaacctctggaaaatgatgaagactgtgcgcactggaaagaagctaagatgcttctagataacatcaacacgcctgaaggaatcattcccagcatgttcgaaccagagcgtgaaaaggtggatgccattgatggtgaataccgcttgagaggagaagcgaggaaaacatttgtggacctaatgagaagaggagacctaccagtctggctagcctacagagtggcagctgaaggtatcaactacgcagacagaagatggtgctttgatggagtcaagaacaaccaaatcctggaagaaaatgtggaagtggaaatttggacaaaagaaggagaaaggaagaaattaaaacccagatggttagatgccaggatctactctgacccactggcgctcaaagaattcaaggaattcgcagctggaagaaaatccctgaccttgaatctaatcaccgagatgggtaggctcccaaccttcatgacccagaaagcaagaaatgcattggacaacttagcagtcctacatacggctgaagcaggcggaagggcgtacaatcatgctcttagtgaactgccggagactctggagacattgcttttactgacactcttggccacagtcacgggtggaatcttcctgttcttgatgagcggaaagggtatagggaaaatgaccctgggaatgtgctgcataatcacggccagtattctcctatggtatgctcaaatacagccacactggatagcagcttcaataatactggagttttttctcatagtcttgctcattccagaaccagagaagcagagaacaccccaagataaccaattaacttatgttgtcatagccatccttacagtggtggccgcaaccatggcaaacgagatgggtttcctggaaaagacaaagaaagatttcggattgggaagcattacaacccagcaacctgacagcaacatcctggacatagatctacgtcctgcatcagcttggactctatatgccgtggcaacaactttcatcacaccaatgttgagacacagcattgaaaattcctcagtgaatgtgtctctaacagccattgctaaccaggccacagtgttaatgggtcttgggaaaggatggccattgtcaaaaatggacatcggagttccccttctcgctatcggatgctattcacaagtcaaccccataactctcacagcagcccttctcttattggtagcacactatgctatcatagggccaggactccaagcgaaagcaactagagaggctcagaaaagagcagcagcgggtatcatgaaaatcccagctgccgatggaataacagtgattgacctagatccaataccctatgatccaaagtttgagaagcagttgggacaagtaatgctcttagtcctctgcgtgactcaagtattgatgatgaggactacatgggctttatgtgaagctctaaccttagcgaccgggcccatctctacactgtgggaaggaaatccagggagattttggaatacaactattgcagtgtcaatggctaacatttttagagggagttacctagccggagccggacttctcttttctatcatgaagaacacggccaacacaagaaggggaactggcaacacaggagagacgcttggagagaaatggaaaaaccggttaaatgcattggggaagagtgaattccagatctataagaaaagtggaatccaggaagtggatagaaccttagcaaaagaaggcatcaaaaggggagaaacggaccatcacgctgtgtcgcgaggctcggcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacatgaagagcccattcccatgtcaacatatggttggaatctggtgcgtcttcaaagtggagttgatgtcttttttactccgccagagaagtgtgacacattgctgtgtgacataggggagtcgtcaccaaaccccacggttgaggcaggacgaacactcagagttctaaacttagtggaaaactggctgaacaacaacacccaattttgcataaaggttctcaacccatatatgccttcagttatagaaaaaatggaagcgctacaaaggaaatacggaggagctttggtgaggaatccactctcacgaaattccacacacgagatgtactgggtatccaatgcttccgggaacatagtgtcatcagtgaacatgatttcaagaatgttgattaacagattcacaatgaaacataagaaggccacatacgagccagatgttgatctcggaagtgggacccgcaacatcggaattgaaagtgagacaccaaatttagacataattgggaaaagaatagaaaaaataaaacaagagcatgaaacatcatggcactatgaccaggaccacccatacaaaacgtgggcctaccatggcagctacgaaacaaaacagactggatcagcatcatccatggtgaacggagtagttaggctgctaacaaaaccttgggacgtcatccctatggtgacacagatggcaatgacagacacgactccatttggacaacagcgcgttttcaaagaaaaagtggacacgagaacccaagaaccgaaagaaggcacgaaaaaactaatgaaaatcacggcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgagacatgtgtgtataacatgatgggaaagagagagaagaagctaggggagttcggtaaagcaaaaggcagcagagctatatggtacatgtggcttggagcacgcttcttagagttcgaagccctaggatttttgaatgaagaccactggttttccagagagaactccctgagtggagtggaaggagaagggctgcacaaactaggctacattttaagagacgtgagtaagaaagaaggaggagcaatgtacgccgatgacaccgcaggatgggacacaagaatcacactagaggacttaaaaaatgaagaaatggtgacaaaccacatggaaggagaacacaggaaacttgctgaagctattttcagattaacgtaccaaaacaaggtggtgcgtgtgcaaagaccgacaccaagaggcacagtaatggacattatatcgagaagagaccaaagaggtagtggacaagttgtcacttacggcctcaatactttcaccaacatggaagcccaactgatcagacagatggagggagaaggagtcttcaaaagcatccaacacctgacagtcacagaagaaattgcagtgaaaaactggttagaaagagtggggcgtgagaggttatcaagaatggccatcagtggagatgattgtgttgtgaaacccttagatgacaggtttgcaagcgctctaacagctctaaatgacatgggaaaggttaggaaagacatacaacaatgggaaccttcaagaggatggaacgattggacacaagtgcccttttgttcacaccatttccatgagttaatcatgaaagacggtcgtgtacttgtagttccatgcagaaaccaagatgaactgattggtagggcccgaatttcccagggagccgggtggtccttgcgggaaacagcctgtttggggaagtcttacgcccaaatgtggagcctgatgtacttccacaggcgtgaccttagactggcggcaaatgccatttgctcggcagtcccatcacattgggttccaataagtcgaacaacctggtccatacacgccacacatgagtggatgacaacagaagacatgctgacagtctggaacagggtgtggattcaagaaaatccatggatggaagacaaaactccagtagaatcatgggaggaaatcccatatctggggaaaagagaagaccaatggtgcggctcattgattgggctaacaagcagggccacctgggcaaagaacatccaaacagcaataaatcaagttagatccctaataggcaatgaggaatacacagactacatgccatccatgaaaagattcagaagagaagaggaagaggcaggagtcttgtggtaa

SEQ ID NO: 6432 - RNA, 9876 nt, synthetic construct
  misc_feature 1..9876: note = derived and/or modified CDS sequence (wt) from DENV-2__KM279515__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaactggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgccttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcattacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggcgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaaacatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6433 - RNA, 9876 nt, synthetic construct
  misc_feature 1..9876: note = derived and/or modified CDS sequence (wt) from DENV-2__KM279516__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacgggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagaacatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6434 - RNA, 9876 nt, synthetic construct
  misc_feature 1..9876: note = derived and/or modified CDS sequence (wt) from DENV-2__KM279517__SS-prME
  source 1..9876: mol_type = other RNA
actgcaggtataattattatgatgatcccaacagtgatggcgttccatttaaccacacgcaacggagaaccacacatgatcgttagtagacaagagaaggggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttacgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcctagacctgccgttaccatggctgcccggagcagacacacaaggatcaaattggatacagaaggagacactggtcactttcaaaaatccccatgcaaagaaacaggatgttgttgtcttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattacagtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtggttgcgttgtgagttggaaaaacaaagaactgaaatgtggtagtgggatttttatcacagacaacgtgcacacatggacagagcaatacaaattccaaccagaatcccctccaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctgggagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggatagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgtcttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaaacactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgaaccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccgtttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgctatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggtagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacggaagacatgttgacagtctggaacagggtgtggattcaagaaaacccatggatggaagacaaaactccagtagaatcatgggaggaaatcccgtacttggggaaaagagaagaccaatggtgcggctcattgattgggctaacaagcagggccacctgggcaaagaacatccagacagcaataaatcaagttagatccctaataggcaatgaggaatacacagactacatgccatctatgaaaagattcagaagagaagaggaagaggcaggagtcttgtggtag

SEQ ID NO: 6435 - RNA, 9876 nt, synthetic construct
  misc_feature 1..9876: note = derived and/or modified CDS sequence (wt) from DENV-2__KM279518__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaagcatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaattacactagaggacttaaaaaatgaagaaatggtgacaaaccacatggaaggagaacacaagaaacttgctgaagccattttcaaattaacgtaccaaaacaaggtggtgcgtgtgcaaagacaaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6436 - RNA, 9876 nt, synthetic construct
  misc_feature 1..9876: note = derived and/or modified CDS sequence (wt) from DENV-2__KM279519__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttgggaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagtcgcagtctctttcgtgacattgatcacagggaacatgtcctttcgagatttagggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgcagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6437 - RNA, 9876 nt, synthetic construct
  misc_feature 1..9876: note = derived and/or modified CDS sequence (wt) from DENV-2__KM279520__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgagaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgccttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcattacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagttccatcacattggattccaacaagtcgaacaacctggtccatacacgccacacatgagtggatgacaacagaagacatgttgacagtctggaacagggtgtggattcaagaaaacccatggatggaagacaaaactccagtagaaacatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6438 - RNA, 9876 nt, synthetic construct
  misc_feature 1..9876: note = derived and/or modified CDS sequence (wt) from DENV-2__KM279521__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcacagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcctgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacatcttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagacgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgcgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6439 - RNA, 9876 nt, synthetic construct
  misc_feature 1..9876: note = derived and/or modified CDS sequence (wt) from DENV-2__KM279583__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggcgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggccttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaaaaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagcggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6440 - RNA, 9876 nt, synthetic construct
  misc_feature 1..9876: note = derived and/or modified CDS sequence (wt) from DENV-2__KM279585__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttgttagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaagatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatcctcacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggataattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgcctggggaagtcctacgcccaaatgtggaacctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6441 - RNA, 9876 nt, synthetic construct
  misc_feature 1..9876: note = derived and/or modified CDS sequence (wt) from DENV-2__KM279525__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacgggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgatattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagaacatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaacgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6442 - RNA, 9876 nt, synthetic construct
  misc_feature 1..9876: note = derived and/or modified CDS sequence (wt) from DENV-2__KM279528__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcttgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccatacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccaaagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaactccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagacttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaattacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggcagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaagcccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6443 - RNA, 9876 nt, synthetic construct
  misc_feature 1..9876: note = derived and/or modified CDS sequence (wt) from DENV-2__KM279533__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggtatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggagggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgagggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaaaacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6444 - RNA, 9876 nt, synthetic construct
  misc_feature 1..9876: note = derived and/or modified CDS sequence (wt) from DENV-2__KM279535__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaagacaggatgtgttttgtgactcaaaactcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatctcgtgcgttccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6445 - RNA, 9876 nt, synthetic construct
  misc_feature 1..9876: note = derived and/or modified CDS sequence (wt) from DENV-2__KM279539__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatctctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaagaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaggactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6446 - RNA, 9876 nt, synthetic construct
  misc_feature 1..9876: note = derived and/or modified CDS sequence (wt) from DENV-2__KM279543__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggaatgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtactgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagagaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6447 - RNA, 9876 nt, synthetic construct
  misc_feature 1..9876: note = derived and/or modified CDS sequence (wt) from DENV-2__KM279571__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6448 - RNA, 9876 nt, synthetic construct
  misc_feature 1..9876: note = derived and/or modified CDS sequence (wt) from DENV-2__KM279544__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaacatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggaatgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagagaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactctagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6449 - RNA, 9876 nt, synthetic construct
  misc_feature 1..9876: note = derived and/or modified CDS sequence (wt) from DENV-2__KM279549__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacacctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgtagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggtatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggagggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgagggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6450 - RNA, 9876 nt, synthetic construct
  misc_feature 1..9876: note = derived and/or modified CDS sequence (wt) from DENV-2__KM279552__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcacagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccattttcatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6451 - RNA, 9876 nt, synthetic construct
  misc_feature 1..9876: note = derived and/or modified CDS sequence (wt) from DENV-2__KM279557__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattggtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggtatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggagggaaatccaggaagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgagggaaagtgtgaaacgtgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaattccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6452 - RNA, 9876 nt, synthetic construct
  misc_feature 1..9876: note = derived and/or modified CDS sequence (wt) from DENV-2__KM279591__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccgggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaattgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacgggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgtcccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgtagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggtatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggagggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacatgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgagggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacactgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6453 - RNA, 9876 nt, synthetic construct
  misc_feature 1..9876: note = derived and/or modified CDS sequence (wt) from DENV-2__KM279558__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaaataacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatctcgtgcgttccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6454 - RNA, 9876 nt, synthetic construct
  misc_feature 1..9876: note = derived and/or modified CDS sequence (wt) from DENV-2__KM279564__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggttgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaaataacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatctcgtgcgttccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagtaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttgatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaatagaagaggaagaggcaggagtcttgtggtag

SEQ ID NO: 6455 - RNA, 9876 nt, synthetic construct
  misc_feature 1..9876: note = derived and/or modified CDS sequence (wt) from DENV-2__KM279595__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcaccgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacgggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacagcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaaacatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttactggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaagactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6456 - RNA, 9876 nt, synthetic construct
  misc_feature 1..9876: note = derived and/or modified CDS sequence (wt) from DENV-2__KM279566__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcaccgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacagcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagctgggacaagtaatgctcttagtcctctgcgtgacccaagtattgatgatgaggactacatgggctttatgtgaagctctaaccttagcaactgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6457 - RNA, 9876 nt, synthetic construct
  misc_feature 1..9876: note = derived and/or modified CDS sequence (wt) from DENV-2__KM279574__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgcactgaaacatggatgtcatcagaaggggcctggaaacatgcccagagaattgaaacttggatcttgagacatccaggcttcaccataatggcagctatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaaatcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctattagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaagggatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcacttcgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttggaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaacaagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6458 - RNA, 9876 nt, synthetic construct
  misc_feature 1..9876: note = derived and/or modified CDS sequence (wt) from DENV-2__KM279568__SS-prME
  source 1..9876: mol_type = other RNA
actgcaggtataattattatgatgatcccaacagtgatggcgttccatttaaccacacgcaacggagaaccacacatgattgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgcataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaacacaacaacagcatctcgctgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaaataacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatattgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtcagttggaaaaacaaagaactgaaatgtggtagtgggatttttatcacagacaatgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcggcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagaaatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatctcgtgcgttccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaactttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaagggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgtttttttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagctttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacattcaaacagcaataaatcaagttagatccctaataggcaatgaggaatacacagactacatgccatctatgaaaagattcagaagagaagaggaagaggcaggagtcttgtggtag

SEQ ID NO: 6459 - RNA, 9876 nt, synthetic construct
  misc_feature 1..9876: note = derived and/or modified CDS sequence (wt) from DENV-2__KM279569__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcttgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgctggattttgaactgataaaaacagaagccaaacatctcgccactctaaggaagtattgtgtagaggcaaagctgaccaacacaacaacagcatctcgctgcccaacacaaggagaacctagcctaaatgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcaccgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgtagttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggacgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacctcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtaacaagactggagaatctgatgtggaaacaaataacaccagaattgaatcacattctaacagaaaatgaagtaaagttgactatcatgacaggagacatcaaaggaatcatgcaggcaggaaaacgaaccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaatgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacagcaggaccctggcatctaggtaggcttgagatggactttgatttctgcgaaggaaccacagtggtggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttcttaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcaccggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcccggaaagaatccaagagccgtccaaacaaaacccggtctttttaaaaccaacactggaaccataggcgccgtgtctctggacttttctcctggaacgtcaggatctccaatcgtcgataaaaaaggaaaagttgtgggcctttatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctaatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaaaagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagagcgggtgatcttggcaggacccatgccagtgacccattctagtgcagcacaaagaagagggagagtaggaagaaatccaaaaaatgaaaatgaccagtacatatacatgggggaacctctggaaaatgatgaagattgtgcacactggaaagaagctaagatgctcttggataacattaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggagacattgcttttactgacacttttggccacagtcacgggcggaatcttcctgttcttgatgagcggaaaaggtatagggaagatgaccctgggaatgtgctgcataatcacggctagtatcctcttatggtatgcacaaatacagccacactggatagcagcttcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagcccttctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgacccaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttcttcactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgcgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttgaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaagactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6460 - RNA, 9876 nt, synthetic construct
  misc_feature 1..9876: note = derived and/or modified CDS sequence (wt) from DENV-2__KM279570__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcctgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaatacaacaacagcatctcgttgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtgacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggcggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggcctttttaaaaccaacactggaaccataggcgccgtgtctctggacttttctcctggaacgtcaggatctccaatcgtcgataaaaaaggaaaagttgtgggcctctatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctgatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagaacgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaagggtatagggaagatgaccctgggaatgtgttgcataatcacggctagtatcctcttatggtatgcacaaatacagccacactggatagcagcctcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattacaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagccctcctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6461 - RNA, 9876 nt, synthetic construct
  misc_feature 1..9876: note = derived and/or modified CDS sequence (wt) from DENV-2__KM279596__SS-prME
  source 1..9876: mol_type = other RNA
actgcaggtataattattatgatgatcccaacagtgatggcgttccatttaaccacacgcaacggagaaccacacatgatcgttagtagacaagagaaagggaaaagtctcctgtttaaaacagagaacggtgtgaacatgtgtaccctcatggccatggaccttggtgaactgtgtgaagacacaatcacttataattgtcctcttctcaggcagaatgaaccagaagacatagactgttggtgcaactccacgtctacatgggtaacttatgggacatgcaccgccacaggagaacacagaagggaaaaaagatcagtggcactcgttccacatgtgggaatgggactggagacacgaactgaaacatggatgtcatcagaaggggcctggaaacatgcccagagaattgaaacttggatcctgagacatccaggcttcaccataatggcagcaatcctggcatacaccataggaacaacatatttccaaagagtcctgattttcattttactgacagctgtcactccttcaatggcaatgcgttgtataggaatatcaaatagagactttgtggaaggggtttcaggaggaagctgggttgatatagtcttggaacatggaagctgtgtgacgacgatggcgaaaaataaaccaacgttggattttgaactgataaaaacagaagccaaacatctcgccactctaaggaagtattgtgtagaggcaaagctgaccaatacaacaacagcatctcgttgcccaacacaaggagaacctagcctaaacgaagaacaggacaaaagattcgtctgcaaacactccatggtagacagaggatggggaaatggatgcggattatttggaaagggaggcatcgtgacctgtgcaatgttcacatgcaaaaagaacatggaaggaaaagtcgtgcaaccagaaaacttggagtacaccatcgtgataacacctcactcaggggaagagaatgcagtcggaaatgacacaggaaaacatggcaaggaaattaaagtaacaccacagagttccatcacagaagcagaactaacaggctacggcactgtcacgatggaatgctctccgagaacgggcctcgacttcaatgagatggtgttgctgcaaatggaaaacaaggcttggctggtgcacaggcaatggttcttagacctgccgttaccatggctgcccggagcagacacacaaggatcaaattggatacagaaggagacactggtcactttcaaaaatccccatgcaaagaaacaggatgttgttgttttaggttcccaagaaggggccatgcacacggcactcacaggggccacggaaatccagatgtcatcaggaaacttactgttcacaggacatcttaagtgcaggctgagaatggacaaactacagctcaaaggaatgtcatattccatgtgtacaggaaagttcaaagttgtgaaggaaatagcagaaacacaacatggaacaatagttattagagtacaatatgaaggggacggttccccgtgcaagatcccttttgaaataatggacttggaaaaaaggcatgtcttaggtcgcttgattaccgtcaacccaattgtcacagaaaaagacagcccagtcaacatagaagcagaacctccatttggagacagttacatcattataggagtagaaccaggacaactgaagctcagctggtttaagaaaggaagttctattggccaaatgtttgagacaacaatgagaggagcgaagagaatggccattctaggtgacacagcttgggattttggatccctgggaggagtgttcacatctataggaaaggccctccaccaagtctttggagctatctatggggctgccttcagtggggtttcatggactatgaaaatcctcataggagtcgtcatcacatggataggaatgaattcacgcagcacttcactgtctgtgtcactagtattagtgggggtcgtgacattgtatttgggagttatggtgcaggccgatagtgggtgcgttgtgagttggaaaaacaaagaactgaaatgtggtagtgggatttttatcacagacaacgtgcacacatggacagaacaatacaaattccaaccagaatccccttcaaagctggcttcagctatccagaaggctcatgaagaaggcatttgtggaatccgctcagtgacaagactggagaatctgatgtggaaacaaataacaccagaattgaatcacattctaacagaaaatgaagtaaagttgactatcatgacaggagacatcaaaggaatcatgcaggcaggaaaacgatccctgcggcctcaacccactgagctgaagtactcctggaaggcatggggcaaagcgaaaatgctttccacagagcttcataaccacacctttctcattgatggccccgaaacagcagaatgtcccaacacaaacagagcttggaactcactagaagttgaagactatggctttggagtattcaccactaacatatggctgaaattgaaagaaaggcaggatgtgttttgtgactcaaaactcatgtcagcagccataaaggacaatagagccgtccacgccgatatgggttattggatagaaagcgcactcaacgacacatggaagattgagaaagcctcttttattgaagttaaaagctgccactggccaaagtcacacactctctggagtaatggagtgctggaaagtgagatgataattccaaagaattttgcaggaccagtttcacaacacaattacagaccaggctaccacacacaaacggcaggaccctggcatctaggtaggcttgagatggactttgatttctgcgaaggaaccacagtggcggtgactgaggactgtggaaatagaggaccctccttaagaacaactactgcttctggaaaactcataacagagtggtgctgccgatcttgcacattaccaccgctaaggtacagaggtgaggatggatgctggtatggtatggaaatcaggccattgaaagagaaagaagagaacctggtcaactctttggtcacagccggacatggacagattgacaacttctcactaggagtcttgggaatggcattgttcctggaagagatgctcaggactcgagtaggaacgaaacatgcaatattactagttgcagtctctttcgtgacattgatcacagggaacatgtcctttcgagatttggggagagtgatggtcatggtgggcgctactatgacggatgacataggcatgggcgtgacttatcttgccctattagcagcctttaaagtcagaccaacctttgcggctggactactcttaagaaagctgacctccaaggaattgatgatgaccaccataggaatcgtactcctctctcagagtaccataccagagagcatacttgaactgactgacgcgttggctttggggatgatggttctcaaaatagtgagaaacatggaaaagtatcagctagcagtgactatcatggcaatcttgtgcgtcccaaatgcagtgatattgcaaaatgcatggaaagtgagctgcacaacactggcagtggtgtccgtttccccactgcttttaacatcctcacagcagaaagcggattggataccactggcgttgacgatcaaaggcctcaatccaacagccattttcttaacaactctctcaagaactagcaagaaaaggagctggccactaaatgaggctattatggcagtcgggatggtgagcattctagctagttctctcttaaagaatgatattcccatgacaggaccattagtggctggagggcttctcactgtgtgttacgtgctcactggaaggtcggctgacttggaactggaaagagctgctgacgtaagatgggaagaacaggcagagatatcaggaagtagtccaattctgtcgataacaatatcggaagatggtagcatgtcgataaagaatgaagaagaagaacagacactgaccatactcatcagaacaggactactggtgatatcaggactttttcctgtgtcaataccaatcacggcagctgcatggtacctttgggaagtgaaaaaacaacgagcaggagtattgtgggatgtcccttcacccccacctgtgggaaaggccgaactggaagatggagcctatagaatcaagcagaaagggatcctaggatactcacagattggagccggagtttacaaagaaggaacattccacacaatgtggcatgtcacacgtggtgctgtcctaatgcataaagggaagagaattgaaccatcatgggcggacgtcaagaaagacctaatatcgtatggaggaggctggaagctggaaggagaatggaaggaaggagaagaagtccaggtcctggcattagagcctggaaagaatccaagagccgtccaaacaaaacccggcctttttaaaaccaacactggaaccataggcgccgtgtctctggacttttctcctggaacgtcaggatctccaatcgtcgataaaaaaggaaaagttgtgggcctctatggcaacggtgtcgtcacaaggagtggaacatatgtgagtgccatagcccagactgaaaaaagcatcgaagacaatccagagattgaagatgacatctttagaaagaaaagattgaccatcatggacctccacccaggagcaggaaaaacaaagagataccttccagcaatagtcagagaagccataaaacgaggcttgagaacactaatcctggcccccactagagttgtggcggctgaaatggaagaagctctcagaggacttccaataagataccaaaccccagctatcagagctgagcacactgggcgggagattgtggatctgatgtgtcatgccacatttaccatgaggctattatcaccaattagagtgccaaattacaacctgatcatcatggatgaagcccatttcacagacccagcaagcatagcagctagaggatacatttcaactcgagtagagatgggtgaagcagctgggattttcatgacagccacccctcctggaagcagagacccatttccccagagcaacgcaccaatcatggatgaagaaagagaaatccctgagcgttcgtggaactctggacatgagtgggttacggattttaaagggaagactgtttggtttgttccaagtataaaagcagggaatgatatagcagcttgcctgagaaagaatggaaagaaagtgatacaactcagcaggaaaacttttgattctgaatatatcaagactaggaccaatgattgggactttgtggtcacgacagacatttcagaaatgggtgctaacttcaaggctgagagggttatagaccccagacgctgcatgaaaccagtcatattaacagacggtgaagaacgggtgatcttggcaggacccatgccagtgacccattctagtgcagcacaaagaagagggagagtaggaagaaatccaaaaaatgaaaatgaccagtacatatacatgggggaacctctggaaaatgatgaagactgtgcacactggaaagaagctaagatgctcttggataacatcaacacgcctgaaggaatcattcccagcatgttcgaaccagagcgtgaaaaggtggatgccattgatggtgaataccgcttgagaggagaagcgaggaaaacttttgtggacctaatgagaagaggagatttaccagtctggctagcctacagagtggcggctgaaggcatcaactacgcagacagaagatggtgctttgatggagtcaagaacaaccaaatcttggaagaaaatgtggaagtagaaatttggacaaaagaaggagaaaggaagaaattaaaacccagatggttggatgctaggatctactctgacccattggcgctcaaagaattcaaggaattcgcagctggaagaaagtccctgaccctgaatctaatcacagagatgggtagactcccaaccttcatgacccagaaagcaaagaatgcactcgacaacttagcagtcctgcatacggctgaagcaggcggaagggcgtacaatcatgctcttagtgaactgccggagactctggaaacattgcttttactgacacttttggccacagtcacgggcggaatcttcctgttcttgatgagcggaaagggtatagggaagatgaccctgggaatgtgttgcataatcacggctagtatcctcttatggtatgcacaaatacagccacactggatagcagcctcaataatactggagttttttctcatagtcttgctcattccagaaccagaaaaacagagaacaccccaagataaccagttaacttatgttgtcatagccatccttacagtagtggccgcaaccatggcaaacgagatgggtttcctggaaaaaacaaagaaagatttcggattgggaagcattgcaacccagcaacctgagagtaacatcctggacatagatctacgtcctgcatcagcttggactctatatgccgtggcaacaactttcatcacaccaatgttgaggcatagcattgaaaactcctcagtgaatgtgtccctaacagccattgccaaccaagccacagtgttaatgggtcttgggaaaggatggccattgtcaaaaatggacatcggagttccccttctcgctatcgggtgctattcacaagtcaaccccataactctcactgcagccctcctcttattggtagcccattatgccatcatagggccaggactccaagcgaaagcaactagagaggctcagaaaagagcagcagcgggcatcatgaaaaacccaactgtggatggaatgacagtgattgacctagatccaataccctatgatccaaagtttgaaaagcagttgggacaagtaatgctcttagtcctctgcgtgactcaagtattgatgatgaggactacatgggctttatgtgaagctctaaccttagcaaccgggcccatctctacactgtgggaaggaaatccagggagattttggaatacaactattgcagtgtcaatggctaacatttttagagggagttacctggccggagccggacttctcttttctatcatgaaaaacacggccaacacaagaaggggaactggcaacacaggagagacgcttggggagaaatggaaaaaccggttgaatgcattagggaagagtgaattccagatctacaagaaaagtggaatccaggaagtggacagaaccttagcaaaagaaggcatcaaaagaggagaaacggaccatcacgctgtgtcgcgaggctcagcgaaactgagatggttcgtcgagagaaacctggtcacaccagaagggaaagtagtggaccttggctgcggcagggggggctggtcatactattgtgggggactaaagaatgtaaaagaagtcaaaggcctaacaaaaggaggaccaggacacgaagaacccattcccatgtcaacatatggttggaatctggtgcgccttcaaagtggagttgatgttttttttactccgccagaaaagtgtgacacactgctgtgtgacataggggagtcgtcaccaaaccccacggttgaggcaggacgaacactcagagttctaaacttagtggaaaattggctgaacaacaacacccaattttgcataaaggttcttaacccatacatgccctcagttatagaaaaaatggaagcactacaaaggaaatacggaggagctttggtgaggaatccactctcacgaaattccacacacgagatgtactgggtatccaatgcttccgggaatatagtgtcatcagtgaacatgatttcaagaatgttgattaacagattcacaatgagacacaagaaagccacatacgagccagatgttgacctcggaagtggaacccgcaacatcggaattgaaagtgagacaccaaatttagacataattgggaaaagaatagaaaaaataaaacaagagcatgaaacatcatggcactatgaccaagaccacccatacaaaacgtgggcctaccatggcagctacgaaacaaaacagactggatcagcatcatccatggtgaacggagtggttaggctgctaacaaaaccttgggacgtcatccctatggtgacacagatggcaatgacagacacgactccatttggacaacagcgcgttttcaaagagaaagtggacacgagaacccaagaaccgaaagaaggcacgaaaaaactaatgaaaattactgcagaatggctctggaaagaactaggaaagaaaaagacacctaggatgtgcaccagagaagaattcacaagaaaggtgagaagcaatgcagccttaggtgccatattcactgatgagaacaagtggaagtcggcacgtgaggctgttgaagacagtggattttgggaattggttgacaaggaaaggaatctccatcttgaaggaaagtgtgaaacatgtgtgtataacatgatgggaaagagagagaagaagctaggggagttcggcaaagcaaaaggcagcagagccatatggtacatgtggcttggagcacgcttcttagagtttgaagctctaggattcttgaacgaagatcactggttttccagagagaactccctgagtggagtggaaggagaagggctacacaagctaggctacattttaagagacgtgagtaagaaagaaggaggagcaatgtatgctgatgacaccgcaggatgggacacaagaatcacactagaggacttaaaaaatgaagaaatggtgacaaaccacatggaaggagaacacaagaaacttgctgaagccattttcaaattaacgtaccaaaacaaggtggtgcgtgtgcaaagaccaacaccaagaggcacagtaatggacattatatcgagaagagaccaaagaggtagtggacaagttgtcacctacggcctcaatactttcaccaatatggaagcccaactgatcagacagatggagggagaaggagttttcaaaagcatccagcaactgacagtaaaagaagaaattgcagtgaaaaactggttaataagagtggggcgtgagaggttatcaagaatggccatcagtggagatgattgtgttgtgaaacccttagatgacaggtttgcaagtgctctaacagctctaaatgacatgggaaaggttaggaaagacatacaacaatgggaaccttcaagaggatggaacgattggacacaagtgcccttttgttcacaccatttccatgagttaatcatgaaggacggtcgtgtgctcgtagttccatgcagaaaccaagatgaactgattggcagggcccgaatttcccagggagccgggtggtccttgcgggaaacagcctgtctggggaagtcctacgcccaaatgtggagcctgatgtacttccacagacgtgaccttaggctggcggcaaatgccatttgctcggcagtcccatcacattggattccaacaagtcgaacaacctggtccatacacgccacacatgagtggatgacaacagaagacatgttgacagtctggaacagggtgtggattcaagaaaacccatggatggaagacaaaactccagtagaatcatgggaggaaatcccgtatttggggaaaagagaagaccaatggtgcggctcattgattgggctaacaagcagggccacctgggcaaagaacatccaaacagcaataaatcaagttagatccctaataggcaatgaggaatacacagactacatgccatctatgaaaagattcagaagagaagaggaagaggcaggagtcttgtggtag

SEQ ID NO: 6462 - RNA, 9876 nt, synthetic construct
  misc_feature 1..9876: note = derived and/or modified CDS sequence (wt) from DENV-2__FJ850072__SS-prME
  source 1..9876: mol_type = other RNA
acagcaggcgtgattattatgttgattccaacagcaatggcgttccatttaaccacacgtaatggagaaccacacatgatcgttggtaggcaagagaaagggaaaagtcttctgtttaaaacagaggatggtgtcaacatgtgcaccctcatggccatggaccttggtgaattgtgtgaagatacaatcacgtacaagtgtcccctcctcaggcaaaatgaaccagaagacatagattgttggtgcaactctacatccacatgggtaacttatgggacatgtaccaccacaggagaacacagaagagaaaaaagatcagtggcactcgttccacatgtgggtatgggactggagacacgaactgaaacatggatgtcatcagaaggggcctggaaacatgttcagagaattgaaacctggatcttgagacatccaggctttgccataatggcagcaatcctggcatataccataggaacgacacatttccaaagggccttgatttttatcttactgacagctgtcgctccttcaatgacaatgcgttgcataggaatatcaaatagagacttcgtagaaggggtttcaggaggaagctgggttgacatagtcttagaacatggaagttgtgtgacgacgatggcaaaaaacaaaccaacattggattttgaactgataaaaacagaagccaaacaacctgccactctaaggaagtactgtatagaagcaaagctgaccaatacaacaacagaatctcgttgcccaacacaaggggaacccagtctaaatgaagagcaggacaaaaggttcatctgcaaacactccatggtagacagaggatggggaaatggatgtggattatttggaaaaggaggcattgtgacctgtgctatgttcacatgcaaaaagaacatggaaggaaaagtcgtgctgccagaaaatctggaatacaccatcgtgataacacctcactcaggagaagagcacgctgtaggtaatgacacaggaaaacatggcgaggaaatcaaaataacaccacagagttccatcacagaagcagaactgacaggctatggcactgtcacgatggagtgctctccgagaacgggcctcgacttcaatgagatggtgctgctgcagatggaagagaaagcttggctggtgcacaggcaatggttcctagacctgccgttaccatggctacccggagcggacacacaaggatcaaattggatacagaaagagacattggtcactttcaaaaatccccatgcgaagaaacaggatgtcgttgttttaggatctcaagaaggggccatgcacacggcactcacaggggccacagaaatccagatgtcatcaggaaacttactgttcacaggacatctcaagtgcaggctgagaatggacaaactacagctcaaaggaatgtcatactctatgtgtacaggaaagtttaaaattgtgaaggaaatagcagaaacacaacatggaacaatagttatcagagtacaatatgaaggggacggctctccatgcaagatcccttttgagataatggatttggaaaaaagacacgccttaggtcgcctgattacagttaacccaatcgtaacagaaaaagatagcccagtcaacatagaagcagaacctccattcggagacagctacatcatcataggagtagagcccggacaattgaaactcaattggtttaagaagggaagttccatcggccaaatgtttgagacaacaatgagaggagcgaagagaatggccatattaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagtacctcactgtctgtgtcactagtattggtgggagtcgtgacactgtacctgggagctatggtgcaggctgatagtggttgcgttgtgagctggaaaaacaaagaattgaaatgtggcagcgggatattcattacagataacgtgcacacatggacagagcaatataagttccaaccagaatccccttcaaagctagcttcagctatccaaaaagctcatgaagagggcatttgtggaatccgctcagtaacaagattggagaatttgatgtggaaacaaataacaccagaattgaatcacatcctatcagaaaatgaggtaaagttgaccattatgacaggagacatcaaaggaatcatgcaggcaggaaaacgatctttgcggccccagcccactgagctgaagtactcatggaaaacatggggaaaggcgaaaatgctctccacagagtctcacaatcagacctttcttattgatggccctgaaacagcagaatgccccaacacaaacagagcttggaactcgttggaagttgaagactatggttttggagtttttaccaccaatatatggctaaaactgagagaaaaacaggatgtattttgtgactcaaaactcatgtcagcggccataaaagacaacagagccgtccatgccgatatgggttattggatagaaagtgcactcaatgacacatggaagatggagaaagcctctttcattgaagtcaaaagctgccactggccaaagtcccacaccctctggagcaatggagtattggaaagtgagatgataattccaaaaaattttgccgggccagtgtcacaacacaactacagaccaggttaccacacacaaacagcaggaccttggcatctaggtaagcttgagatggacttcgatttctgcgaaggaaccacagtggtggtgactgaggactgtggaaatagaggaccctctttaagaacgaccactgcctctggaaaacttataacagaatggtgctgccgatcttgcacactaccacctctaagatacagaggtgaggatggatgctggtacgggatggaaatcagaccattgaaagagaaagaggagaatttggtcaactccttggtcacagccggacatgggcagattgacaacttttcgctaggagtcttgggaatggcactgtttctggaagaaatgctcaggacccgagtaggaacgaaacatgcaatactgctagtcgcagtatcttttgtgacattgatcactgggaacatgtcctttagagacttgggaagagtgatggttatggtgggcgttgccatgacggatgatataggtatgggagtgacttaccttgccctattagcagctttcaaagttagaccaactttcgcagctggactactcttgagaaaactgacctccaaggaattaatgatggccaccataggaattacactcctttcccaaagcaccataccagaaaccattcttgaactgactgatgcgttagccttgggcatgatggtcctaaaaatagtgagaaatatggaaaagtaccaattggcagtgaccatcatgactatctcgtgtgtcccaaatgcaatgatactgctaaacgcatggaaggtgagttgcacaatattggcagtggtgtccgtttctccattgctcctaacatcctcacagcagaaaacggattggataccactagcattgacgataaaaggtctcaatccaacagccatctttctaacaaccctttcgagaaccagcaagaaaaggagctggccgctaaatgaagctgtcatggcagtcgggatggtgagcattttagccagttctctcctaaagaatgacattcctatgacaggtccattagtggctggagggctccttactgtgtgttacgtgctcactggacgatcggccgatttggaactggagagagctaccgatgtaaaatgggaagatcaggcagaaatatcaggaagcagcccaatcctgtcaataacaatatcagaagatggcagcatgtcgataaagaatgaagaggaagaacaaacactgaccatactcatcagaacgggattgctggtgatctcaggagtttttccagtatcgataccaattacggcagcagcatggtacctgtgggaagtgaagaaacaacgggctggagtattgtgggacgtcccttcacctccaccagtggaaaaagccgaactggaagatggagcttatagaatcaagcaaagagggattcttggatattctcagattggagccggagtttacaaagaaggaacattccacacaatgtggcacgtcacacgtggtgctgttctgatgcatagagggaaaaggattgaaccatcatgggcagacgtcaagaaagacctaatatcatatggaggaggctggaagctagaaggagaatggaaagaaggagaggaagtccaagtcctggcattggaacctggaaaaaatccaagagccgtccaaacgaaacctggacttttcaaaaccaacaccggaaccataggcgccgtgtctctggacttttcccctggaacgtcaggatctccaattgtcgatagaaaaggaaaagttgtgggcctttacggcaatggtgttgtcacaagaagtggagcatatgtgagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccactagagttgtggcggctgaaatggaggaagctcttagaggacttccaataagataccaaaccccagccattagagccgagcacaccgggcgggagattgtggacttaatgtgtcatgccacatttactatgaggctgctatcaccagtcagagtgccaaattacaacctgattatcatggacgaagcccacttcacagatccagcaagtatagcagctagaggatatatttcaactcgagtagaaatgggtgaagcagctgggattttcatgacagccactcctccgggaagtagagacccatttcctcagagcaatgcaccaatcatggatgaggaaagagaaatccctgagcgctcgtggaattcaggacatgaatgggtcacggattttaaagggaagactgtttggtttgttccaagtataaaagcaggaaatgacatagcagcttgtctcagaaaaaatggaaagaaagtgatacaactcagtaggaagacttttgactctgagtatgttaagactagagccaatgattgggactttgtggtcacaactgacatttcagaaatgggtgccaacttcagggctgagagggttatagaccccagacgttgcatgaaaccagtcatactaacagatggcgaagagcgagtgattttggcaggacctatgccagtgacccactctagtgcagcacaaagaagagggagagtaggaagaaatccaaaaaatgaaaatgaccagtacatatacatgggggaacctctggaaaatgatgaagactgtgcacattggaaagaagctaaaatgctcctagataacatcaacacacctgaaggaatcattcctagtatgttcgaaccagagcgtgaaaaggtggatgccattgatggtgaataccgtttgagaggagaagcaaggaaaacctttgtggacctaatgagaagaggggacttaccagtctggttggcctacagagtggcagctgagggcatcaactacgcagacagaaggtggtgttttgatggaattaagaacaaccaaatactggaagaaaacgtggaagtggaaatctggacaaaagaaggggaaaggaagaaattaaaacccagatggttggatgctaggatctattctgacccactggcactaaaagaattcaaggaatttgcagctggaagaaaatctttgaccctgaacctaatcacagaaatgggtaggcttccaactttcatgactcagaaggcaagaaacgcactggacaacttagctgtgctgcatacggctgaggcaggtggaagggcgtacaatcatgctctcagtgaactgccggagaccctggagacactgcttttactgacactcctggccacagtcacaggaggaatcttcttattcttaatgagcggaaaaggtatagggaagatgactctgggaatgtgttgcataatcacggctagtatcctcctatggtatgcacagatacaaccacactggatagcagcttcaataatactggagtttttcctcatagttttgctcattccagaaccagaaaaacagagaacaccccaagacaaccaattgacctacgtagtcatagccatcctcacagtggtggccgcaaccatggcaaatgagatgggtttcctggaaaaaaccaagaaagacctcggactgggaagcattacaacccaggaatctgagagcaacatcctggacatagatctacgtcctgcatcagcatggacgctgtatgccgtggctacaacatttatcacaccaatgttgagacatagcattgaaaattcctcagtgaatgtctccctaacagccattgctaaccaagccacagtgctaatgggtcttgggaaaggatggccattgtcaaagatggacatcggagttcccctccttgccattggatgctattcacaagtcaaccctataaccctcacagcagctcttctttcattggtagcacattatgccattatagggccaggacttcaagcaaaggcaaccagagaagctcagaaaagagcagcagcaggcatcatgaaaaacccaacagtcgatgggataacagtgattgacctagaaccaataccctatgatccaaaatttgaaaagcagttaggacaagtaatgctcctaatcctctgcgtgactcaagtattaatgatgaggactacatgggctctgtgtgaggctctaaccctagcgaccgggcccatctccacactgtgggaaggaaatccagggaggttttggaacactaccattgcagtgtcaatggctaacatctttagggggagctacttggccggagctggacttctcttttccatcatgaagaacacaacaaacacaagaagaggaactggcaacataggagagacacttggagaaaaatggaaaagtcgattaaacgcactgggaaaaagtgaatttcagatctacaagagaagtggaatccaggaagtggatagaaccttggcaaaagaaggcatcaaaagaggagaaacggaccaccacgctgtgtcgcgaggctcagcaaaactgagatggttcgtcgagagaaatatggtcacaccagaagggaaggtggtggacctcggttgcggcagaggtggctggtcatactattgtgggggactaaaaaatgtaagagaagtcaaaggcctgacaaaaggaggaccaggacacgaagaacccatccccatgtcaacatatgggtggaatctagtgcgtctgcaaagtggagttgacgtcttcttcaccccgccagaaaagtgtgatacattgttgtgtgacataggggagtcgtcaccaaatcccacgatagaagcaggacggacactcagagtcctcaacttagtagaaaattggttgaacaacaacacccaattttgcataaaggttctcaacccatatatgccctcagtcatagaaaaaatggaaacactacaaaggaaatatggaggagctttagtgaggaatccactctcacgaaactccacacatgagatgtactgggtatccaatgccaccgggaacatagtgtcatcagtgaacatgatttcaaggatgttgattaacagattcacaatgaaacacaagaaagccacctacgagccagatgttgacctaggaagcggaacccgcaacattggaattgaaagtgagataccaaatctagacataataggaaagagaatagagaaaataaagcaagagcatgaaacatcatggcactatgaccaagaccacccatacaaaacatgggcttaccatggtagctatgaaacaaaacaaactgggtcagcatcatctatggtgaacggagtggtcagactgctgacaaaaccttgggacgtcgtcccaatggtgacacagatggcaatgacagacacgactccatttggacaacaacgcgtcttcaaagagaaagtggacacgagaacccaagaaccgaaggaaggcacaaagaaactgatgagaattacggcagagtggctttggaaagaactaggaaagaaaaagacacctaggatgtgtaccagagaagaattcacaagaaaggtgagaagcaatgcagccttgggggccatattcactgatgaaaacaaatggaaatcggctcgtgaggctgttgaagacagtaggttttgggagctggttgacagggaaagaaatctccatcttgaaggaaagtgtgaaacatgtgtgtacaacatgatgggaaaaagagagaagaagctaggggagttcggcaaggcaaaaggtagcagagccatatggtacatgtggcttggagcacgctttttagagtttgaagccctaggattcttaaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagagcacaagaaactagccgaggccgtattcaaattaacgtaccaaaacaaggtggtgcgtgtgcaaagaccaacaccaagaggcacagtaatggatatcatatcgagaagagaccaaagaggcagcgggcaagtcggcacctatggccttaatactttcaccaacatggaagcccaattaattagacagatggagggagaaggaatcttcaaaagcattcagcacctgacagtcacagaagaaatcgctgtacagaactggttagcaagagtggggcgtgaaaggctatcaagaatggccatcagtggagatgattgtgttgtaaaacccttagatgacagatttgcaagtgctttaacagctctaaatgacatgggaaaagttaggaaagatatacaacaatgggaaccttcaagaggatggaacgactggacacaagtgcctttctgttcacaccactttcatgagttagtcatgaaagatggtcgcatgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaatagggtgtggatccaagaaaatccgtggatggaagacaaaactccagtggaatcatgggaagaagtcccatacttggggaaaagagaagaccaatggtgcggctcattgattgggctaacaagcagggctacctgggcaaagaacatccaaacagcaataaatcaagtcagatcccttataggcaatgaggaatacacagactacatgccatccatgaaaaggttcagaagggaagaggaagaggcaggtgtcctgtggtag

SEQ ID NO: 6463 - RNA, 9876 nt, synthetic construct
  misc_feature 1..9876: note = derived and/or modified CDS sequence (wt) from DENV-2__JN819419__SS-prME
  source 1..9876: mol_type = other RNA
acagcaggcgtgattgttatgttgattccaacagcgatggcgtttcatttaaccacacgcaatggagaaccacacatgatcgttggtaggcaggagaaagggaaaagtcttctgttcaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcattttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgctgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttccatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatttggaaaaaagacacgtcttaggtcgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcatcacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctctccacagagtctcacaatcagacctttcttattgatggccccgaaacagcagaatgccccaacacaaacagagcttggaactcgctggaagtcgaagactatggttttggagtttttaccaccaatatatggctaaagttgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggactgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccactaaatgaagctatcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggctggagtattgtgggacgtcccttcacccccaccagtaggaaaagctgaactggaagatggagcctatagaatcaagcaaagagggattctagggtattctcagattggagccggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacaccggaaacataggcgccgtatccctggacttttcccctggaacgtcaggatctccaatcgttgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgagcacaccgggcgggagatcgtggacttaatgtgtcatgccacatttactatgaggctgctatcaccagtcagagtgccaaattacaacctgatcatcatggacgaagcccacttcacagacccagcaagcatagcagctagaggatacatttcaactcgggtggagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcctggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattgaaacccagatggttggatgctaggatctattctgacccactggcactaaaagaattcaaggaatttgcagctgggagaaaatctttgaccctgaacctaatcacagaaatgggtaggcttccaactttcatgactcagaaggcaagaaacgcattggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtagtggccgcaaccatggcgaacgagatgggtttcctggaaaaaaccaagaaagacctcggattgggaagcattacaacccaggaatctgagagcaacatcttggacatagatctacgtcctgcatcagcatggacgctgtatgccgtggctacaacatttgtcacaccaatgttgaggcatagtattgaaaattcctcagtgaatgtctccctaacagccattgctaaccaagctacagtgctgatgggtcttgggaaaggatggccattgtcaaagatggacatcggagctcccctcctcgccattggatgctactcacaagtcaaccctataactctcacagcagctcttctcttattggtagcacattatgccatcatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactaggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccttagtgaggaatccactctcacgaaactccacgcatgagatgtattgggtatctaatgccaccgggaacatagtgtcatcagtgaacatgatttcaaggatgttgattaacagattcacaatgaaacacaagaaagccacctacgagccagatgttgacttaggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagatacctaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggcaatgaggaatatacagactacatgccatccatgaagagattcagaagggaagaggaagaggcaggtgtcctgtggtag

SEQ ID NO: 6464 - RNA, 9876 nt, synthetic construct
  misc_feature 1..9876: note = derived and/or modified CDS sequence (wt) from DENV-2__FJ850074__SS-prME
  source 1..9876: mol_type = other RNA
acagcaggtgtgattgttatgttgattccaacagtgatggcgtttcatttaaccacacgcaatggagaaccacacatgatcgttggcaggcaggagaaagggaaaagtcttctgttcaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccatgatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttctatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatattctatgtgcacaggaaagtttaaaattgtgaaggaaatagcagaaacgcaacatggaacaatagttatcagagtacaatatgaaggggacggttctccatgtaagatcccttttgagataatggatctggaaaaaagacacgtcttaggccgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattttaggtgacacagcttgggattttggatccctgggaggagtgtttacatctataggaaaggctctccaccaagttttcggagcaatctatggggctgcttttagtggggtctcatggactatgaaaatcctcattggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaagctagcttcagctatccagaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctccccacagagtctcacaatcagacctttcttattgatggccccgaaacagcagaatgccccaacacaaacagagcttggaactcgctggaagtcgaagactatggttttggagtttttaccaccaatatatggctaaagttgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggattgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactattatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccactaaatgaagctatcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtaggaaaagctgaactggaagatggagcctatagaatcaagcaaagagggattctaggatattctcagattggagccggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgttgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgattctgagtatgttaagactagatccaatgattgggattttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttacctgtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactggcactaaaagaattcaaggaatttgcagctgggagaaaatctttgaccctgaacctaatcacagaaatgggtaggctcccaactttcatgactcagaaggcaagaaacgcactggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtagtggccgcaaccatggcgaacgagatgggtttcctggaaaaaactaagaaagacctcggattgggaagcattacaacccaggaatctgagagcaacatcttggacatagatctacgtcctgcatcagcatggacgctgtatgccgtggctacaacatttgtcacaccaatgttgaggcatagcattgaaaattcctcagtgaatgtctccctaacagccattgctaaccaagctacagtgctgatgggtcttgggaaaggatggccattgtcaaagatggacatcggagttcccctcctcgccattggatgctactcacaagtcaaccctataactctcacagcagctcttctcttattggtagcacactatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccttagtgaggaatccactctcacgaaactccacgcatgagatgtattgggtatctaatgccaccgggaacatagtgtcatcagtgaacatgatctcaaggatgttgatcaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggatacgagaacccaagaaccgaaggaaggcacaaagaaactgatgaaaattacggcagagtggctttggaaagaactaggaaagaaaaagacacctaggatgtgtaccagagaggaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacggcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggtaatgaggaatatacagactacatgccatccatgaagagattcagaagggaagaggaagaggcaggtgtcctgtggtag

SEQ ID NO: 6465 - RNA, 9876 nt, synthetic construct
  misc_feature 1..9876: note = derived and/or modified CDS sequence (wt) from DENV-2__FJ850076__SS-prME
  source 1..9876: mol_type = other RNA
acagcaggtgcgattgttatgttgattccaacagtgatggcgtttcatttaaccacacgcaatggagaaccacacatgatcgttggcaggcaggagaaagggaaaagtcttctgttcaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccatgatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaaaataacaccacagagttctatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatttggaaaaaagacacgtcttaggccgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcattggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaagctagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctccccacagagtcccacaatcagacctttcttattgatggccccgaaacagcagaatgccccaacacaaacagagcttggaactcgctggaagtcgaagactatggttttggagtttttaccaccaatatatggctaaagttgagagaaaaacaggatgtattttgtgactcaaaactcatgtcagcggccatcaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaactttgccgggccagtgtcacaacacaactacagaccaggctaccatacacaaacagcaggaccttggcatctaggcaagcttgagatggactttgatttctgcgaaggaactacagtggtggtgactgaggattgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagaaaccattcttgaactgactgatgcgttagccttgggcatgatggctctcaaaatagtgaaaaatatggaaaagtaccaattggcagtgactattatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccgacagccatttttctaacgactctttcgagaaccagcaagaaaaggagctggccactaaatgaagctatcatggcagttgggatggtgagcattttagccagttctctcctgaagaatgatgttcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtaggaaaagctgaactggaagatggagcctatagaatcaagcaaagagggattctaggatattctcagattggagccggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgttgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagggacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgattctgagtatgttaagactagatccaatgattgggattttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttacctgtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactggcactaaaagaattcaaggaatttgcagctgggagaaaatctttgaccctgaacctaatcacagaaatgggtaggctcccaactttcatgactcagaaggcaagaaacgcactggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagcatcctcctatggtatgcacagatacaaccacactggatagcagcttcaataatactggagttttttctcatagttttgctcattccagaaccagaaaaacagagaacacctcaagacaaccaattgacctacgttgtcatagctatcctcacagtagtggccgcaaccatggcgaacgagatgggtttcctggaaaaaactaagaaagacctcggattgggaagcattacaacccaggaatctgagagcaacatcttggacatagatctacgtcctgcatcagcatggacgctgtatgccgtggcaacaacatttgtcacaccaatgttgaggcatagcattgaaaattcctcagtgaatgtctccctaacagccattgctaaccaagctacagtgctgatgggtcttgggaaaggatggccattgtcaaagatggacatcggagttcccctcctcgccattggatgctactcacaagtcaaccctataactctcacagcagctcttctcttattggtagcacactatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaaaaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccttagtgaggaatccactctcacgaaactccacgcatgagatgtattgggtatctaatgccaccgggaacatagtgtcatcagtgaacatgatctcaaggatgttgatcaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacggacacgactccatttggacaacagcgcgttttcaaagagaaagtggatacgagaacccaagaaccgaaggaaggcacaaagaaactgatgaaaattacggcagagtggctttggaaagaactaggaaagaaaaagacacctaggatgtgtaccagagaggaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacggcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggtaatgaggaatatacagactacatgccatccatgaagagattcagaagggaagaggaagaggcaggtgtcctgtggtag

SEQ ID NO: 6466 - RNA, 9876 nt, synthetic construct
  misc_feature 1..9876: note = derived and/or modified CDS sequence (wt) from DENV-2__GQ868640__SS-prME
  source 1..9876: mol_type = other RNA
acagcaggtgcgattgttatgttgattccaacagtgatggcgtttcatttaaccacacgcaatggagaaccacacatgatcgttggcaggcaggagaaagggaaaagtcttctgttcaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccatgatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggcaatgacacaggaaagcatggcaaggaaatcaaaataacaccacagagttctatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatttggaaaaaagacacgtcttaggccgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattttaggtgacacagcctgggattttggatccctgggaggagtgtttacatctataggaaaggctctccaccaagttttcggagcaatctatggggctgcttttagtggggtctcatggactatgaaaatcctcattggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaagctagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctccccacagagtcccacaatcagacctttcttattgatggccccgaaacagcagaatgccccaacacaaacagagcttggaactcgctggaagtcgaagactatggttttggagtttttaccaccaatatatggctaaagttgagagaaaaacaggatgtattttgtgactcaaaactcatgtcagcggccatcaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaactttgccgggccagtgtcacaacacaactacagaccaggctaccatacacaaacagcaggaccttggcatctaggcaagcttgagatggactttgatttctgcgaaggaactacagtggtggtgactgaggattgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccattacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactattatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccgacagccatttttctaacgactctttcgagaaccagcaagaaaaggagctggccactaaatgaagctatcatggcagttgggatggtgagcattttagccagttctctcctgaagaatgatgttcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtaggaaaagctgaactggaagatggagcctatagaatcaagcaaagagggattctaggatattctcagattggagccggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgttgacagaaaaggaaaagttgtgggtctttacggtaatggtgttgtcacaaggagtggagcatatgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagggacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgattctgagtatgttaagactagatccaatgattgggattttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttacctgtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactggcactaaaagaattcaaggaatttgcagctgggagaaaatctttgaccctgaacctaatcacagaaatgggtaggctcccaactttcatgactcagaaggcaagaaacgcactggacaacttggctgtgctgcatacggctgaggcaggtggaaaagcgtacaatcatgctctcagtgaactgccggagaccctggagacactgcttctactgacactcctggcaacagtcacaggaggaatcttcttattcttaatgagtggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagctatcctcacagtagtggccgcaaccatggcgaacgagatgggtttcctggaaaaaactaagaaagacctcggattgggaagcattacaacccaggaatctgagagcaacatcttggacatagatctacgtcctgcatcagcatggacgctgtatgccgtggcaacaacatttgtcacaccaatgttgaggcatagcattgaaaattcctcagtgaatgtctccctaacagccattgctaaccaagctacagtgctgatgggtcttgggaaaggatggccattgtcaaagatggacatcggagttcccctcctcgccattggatgctactcacaagtcaaccctataactctcacagcagctcttctcttattggtagcacactatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaaaaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccttagtgaggaatccactctcacgaaactccacgcatgagatgtattgggtatctaatgccaccgggaacatagtgtcatcagtgaacatgatctcaaggatgttgatcaacagattcacaatgaaacacaagaaagccacctacgagccagatgttgacctaggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggatacgagaacccaagaaccgaaggaaggcacaaagaaactgatgaaaattacggcagagtggctttggaaagaactaggaaagaaaaagacacctaggatgtgtaccagagaggaattcacaagaaaggtgagaagcaatgcagccttgggggccatattcactgatgagaacaaatggaaatcggcacgtgaggctgttgaagatggtaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacggcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaacatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagcagggctacctgggcaaagaacatccaaacagcaataaaccaagtcagatcccttataggtaatgaggaatatacagactacatgccatccatgaagagattcagaagggaagaggaagaggcaggtgtcctgtggtag

SEQ ID NO: 6467 - RNA, 9876 nt, synthetic construct
  misc_feature 1..9876: note = derived and/or modified CDS sequence (wt) from DENV-2__FJ850078__SS-prME
  source 1..9876: mol_type = other RNA
acagcaggtgtgattgttatgttgattccaacagtgatggcgtttcatttaaccacacgcaatggagaaccacacatgatcgttggcaggcaggagaaagggaaaagtcttctgttcaaaacagaggatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccaccacaggagaacacagaagagaaaaaagatcagtggcgctcgttccacatgtgggtatgggactggagacacgaactgaaacatggatgtcatcagaaggggcctggaaacatgttcagagaattgaaacctggatcttgagacatccaggctttaccatgatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagttgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcatgctgtaggtaatgacacaggaaagcatggcaaggaaatcaaaataacaccacagagttctatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgttttagggtctcaagaaggggctatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatctggaaaaaagacacgtcttaggccgcctgatcacagttaacccaatcgtaacagaaaaagatagcccagtcaacatagaagcagaacctccattcggagacagctacatcatcgtaggagtagagccgggacaattgaaactcaattggtttaagaagggaagttccatcggccaaatgtttgagacaacgatgagaggagcaaagagaatggccattttaggtgacacagcctgggattttggatccctgggaggagtgtttacatctataggaaaggctctccaccaagtttttggagcaatctatggggctgcttttaatggggtctcatggactatgaaaatcctcattggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaagctagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctccccacagagtctcacaatcagacctttctcattgatggccccgaaacagcagaatgccccaacgcaaacagagcttggaactcgctggaagtcgaagactatggttttggagtttttaccaccaatatatggctaaagttgagagaaaaacaggatgtattttgtgactcaaaactcatgtcagcggccattaaagacaacagagccgtccatgctgatatgggttattggatagaaagtgcactcaatgacacatggaagatggagaaagcctccttcattgaagttaaaagctgccactggccaaagtcacacaccctctggagcaatggagtattagaaagtgagatgataattccaaaaaattttgccgggccagtgtcacaacacaactacagaccaggctaccatacacaaacagcaggaccttggcatctaggcaagcttgagatggactttgatttctgcgaaggaactacagtggtggtgactgaggattgtggaaatagaggaccttctttaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctactatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactattatggccatttcgtgtgtcccaaatgcagtgatattgcaaaacgcatggaaggtgagttgcacaatattggcagcggtgtccgtttctccactgctcttaacatcctcacagcagaaagcggattggataccactggcattgacgataaaaggtctcaatccaacagccatttttctaacgactctttcgagaaccagcaagaaaaggagctggccactaaatgaagctgtcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacggcagcagcatggtacctgtgggaagtgaagaaacaacgggccggagtattgtgggacgtcccttcacccccaccagtagaaaaagctgaactggaagatggagcctatagaatcaagcaaagagggattctaggatattctcagattggagccggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaagaaggagaggaagtccaagtcctggcattagaacctggaaaaaatccaagagccgtccaaacgaaacctggaattttcaaaaccaacaccggaaccataggcgccgtatctctggacttttcccctggaacgtcaggatctccaattgttgacagaaaaggaaaagttgtgggtctttacggtaatggtgttgtcacaaggagtggagcatacgtaagtgctatagcccagaccgaaaaaagcattgaagacaatccagagatcgaagatgacattttccgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataagataccaaaccccagccatcagagccgagcacaccgggcgggagatcgtggacctaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaaaaatggaaagaaagtgatacaactcagtagaaagacttttgattctgagtatgttaagactagatccaatgattgggattttgtggtcacaactgacatttcagaaatgggtgccaacttcaaggctgagagggttatagaccccagacgctgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttacctgtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactggcactaaaagaattcaaggaatttgcagctgggagaaaatctttgaccctgaacctaatcacagaaatgggtaggctcccaactttcatgactcagaaggcaagaaacgcactggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacggctagtatcctcctatggtatgcacagatacaaccacactggatagcagcttcaataatactggagttttttctcatagttttgctcattccagaaccagaaaaacagagaacacctcaagacaaccaattgacctacgttgtcatagccatcctcacagtagtggccgcaaccatggcgaacgagatgggtttcctggaaaaaactaagaaagacctcggattgggaagcattacaacccaggaatctgagagcaacatcttggacatagatctacgtcctgcatcagcatggacgctgtatgccgtggctacaacatttgtcacaccaatgttgaggcatagcattgaaaattcctcagtgaatgtctccctaacagccattgctaaccaagctacagtgctgatgggtcttgggaaaggatggccattgtcaaagatggacatcggagttcccctcctcgccattggatgctactcacaagtcaaccctataactctcacagcagctcttctcttattggtagcacactatgccattatagggccaggacttcaagcaaaagcaaccagagaagctcagaaaagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaaaaatgtaagagaagtcaaaggcctaacaagaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacaatagaagcaggacgaacactcagagtcctcaacctagtggaaaattggttgaacaataacacccaattttgcataaaggtcctcaacccatatatgccctcagtaatagaaaaaatggaaacactacaaaggaaatatggaggagccttagtgaggaatccactctcacgaaactccacgcatgagatgtattgggtatctaatgccaccgggaacatagtgtcatcagtgaacatgatctcaaggatgttgatcaacagattcacaatgaaacacaagaaggccacctacgagccagatgttgacctaggaagtggaactcgcaacattggaattgaaagtgagataccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgtattcaaagaaaaagtggatacgagaacccaagaaccgaaggaaggcacaaagaaactgatgaaaattacggcagagtggctttggaaagaactaggaaagaaaaagacacctaggatgtgtaccagagaggaattcacaagaaaggtgagaagcaatgcagccttgggggccatattcactgatgagaacaaatggaaatcggcacgtgaggctgttgaagatggcaggttttgggagctggttgacagggaaagaaatctccatcttgaaggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacatcttaagagacgtgagcaagaaggaagggggagcaatgtacgctgatgatacggcaggatgggacacaagaatcacactagaagacttaaaaaatgaagaaatggtaacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtggacaagtcggcacctatggccttaatactttcaccaacatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctttgaaggagacggcctgtttggggaagtcttacgcccaaatgtggaccctgatgtacttccacagacgtgacctcagactggcggcaaatgccatttgctcggcagtcccgtcacattgggttccaacaagccgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggctaacaagtagggctacctgggcaaagaacatccaaacagcaataaaccaagtcagatcccttataggtaatgaggaatatacagactacatgccatccatgaagagattcagaagggaagaggaagaggcaggtgtcctgtggtag

SEQ ID NO: 6468 - RNA, 9876 nt, synthetic construct
  misc_feature 1..9876: note = derived and/or modified CDS sequence (wt) from DENV-2__FJ850082__SS-prME
  source 1..9876: mol_type = other RNA
acagtaggcgtgattgttatgttgattccaacagcgatggcgtttcatttaaccacacgcaatggagaaccacacatgatcgttggtaggcaggagaaagggaaaagtcttctgttcaaaacagagaatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagctgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagagaatttggaatacaccatcgtgataacacctcactcaggagaagagcacgctgtaggtaatgacacaggaaagcatggcaaggaaatcaagataacaccacagagttccatcacagaagcagaactgacaggctatggtactgtcacgatggagtgctctccgagaacgggcctcgacttcaatgagatggtgctgctgcagatggaagacaaagcttggctggtacacaggcaatggttcctagacctgccgttaccatggctacccggagcggacacacaaggatcaaattggatacagaaagagacattggtcactttcaaaaatccccacgcgaagaaacaggatgtcgttgtcttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatttggaaaaaagacacgtcttaggtcgcctgatcacagttaacccaatcgtaacagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattttaggtgacacagcctgggattttggatccctgggaggagtgttcacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgacagtggttgcgttgtgagctggaaaaataaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctctccacagagtctcacaatcagacctttcttattgatggccccgaaacagcagaatgccccaacacaaacagagcttggaactcgctggaagtcgaggactatggttttggagtttttaccaccaatatatggctaaagttgagagaaaaacaggatgtattttgtgattcaaaactcatgtcagcggccgttaaagacaacagagccgtccatgctgatatgggttattggatagaaagtgcactcaatgacacatggaagatggagaaagcctccttcattgaagttaaaagctgccactggccaaagtcacacactctctggagcaatggagtattagaaagtgagatgataattccgaaaaattttgccgggccagtgtcacaacacaactacagaccaggctaccatacacaaacagcaggaccttggcacctaggcaagcttgagatggactttgatttctgcgaaggaactacagtggtggtgactgaggactgtggaaatagaggaccttctctaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcaaaaagcggattggataccactggcattgacgataaaaggtctcaatccaacagccatttttttaacgactctttcgagaaccagcaagaaaaggagctggccactaaatgaagctatcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcatcagaacgggattgttggtgatctcaggagtctttccagtatcgataccaattacagcagcagcatggtacctgtgggaagtgaagaaacaacgggctggagtattgtgggacgtcccttcacccccaccagtaggaaaagctgaactggaagaaggagcttatagaatcaagcaaagagggattctaggatattctcagattggagctggagtttacaaagaaggaacattccatacaatgtggcacgtcacacgtggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacactggaaccataggcgccgtatctctggacttttcccctggaacgtcaggatctccaattgttgacagaaaaggaaaagttgtgggtctttacggtaatggtgttgtcacaaggagtggagcatatgtaagtgctatagcccagaccgataaaagcattgaagacaatccagagatcgaagatgacatttttcgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataaggtaccaaaccccagccatcagagccgagcacaccgggcgggagatcgtggacttaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagactgtttggtttgttccaagtataaaagcaggaaatgacatcgcagcttgtcttaggaagaatggaaagaaagtgatacaactcagtagaaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactagcactaaaagaattcaaggaatttgcagctgggagaaaatctttgaccctgaacctaatcacagaaatgggtaggcttccaactttcatgactcagaaggcaagaaacgcactggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagtatcctactatggtatgcacagatacaaccacactggatagcagcttcaataatactggagttttttctcatagttttgctcattccagaaccagaaaaacagagaacacctcaagacaaccaattgacctacgttgtcatagccatcctcacagtagtggccgcaacaatggcgaacgagatgggtttcctggaaaaaaccaagaaagatctcggattgggaagcattacaacccaggaatctgagagcaacatcttggacatagatctacgtcctgcatcagcatggacgctgtatgccgtggctacaacatttgtcacaccaatgttgaggcatagcattgaaaattcctcagtgaatgtctccctaacagccattgctaaccaagctacagtgctgatgggtctcgggaaaggatggccattgtcaaagatggacatcggagttcccctcctcgccattggatgctactcacaagtcaaccctataactctcacagcagctcttctcttattggtagcacattatgccattatagggccaggacttcaagcaaaagcaaccagagaagctcagaagagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttgtgcgaggctctaaccttagcgaccgggcccatctccacattgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacccatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccctagtgaggaatccactctcacgaaactccacgcatgagatgtattgggtatctaatgccaccgggaacatagtgtcatcagtgaacatgatttcaaggatgttgattaacagattcacaatgaaacacaagaaagccacctacgagccagatgttgacctaggaagtggaactcgcaacattggaattgaaagtgaggtaccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtagacacgagaacccaagaaccgaaggaaggcacaaagaaactgatgaaaattacggcagagtggctttggaaagaactaggaaagaaaaagatacctaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgagggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatgataacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattaatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctctgaaggagacggcctgtttggggaagtcttacgcccaaatgtggaccctgatgtacttccacagacgtgacctcagactggcggcaaatgccatttgctcggcagttccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggttaacaagcagggctacctgggcaaagaacatccaaacagcaataaaccaagtcagatccctcataggcaatgagggatatacagactacatgccatccatgaagagattcagaagggaagaggaagaggcaggtgtcctgtggtag

SEQ ID NO: 6469 - RNA, 9876 nt, synthetic construct
  misc_feature 1..9876: note = derived and/or modified CDS sequence (wt) from DENV-2__FJ850085__SS-prME
  source 1..9876: mol_type = other RNA
acagtaggcgtgattgttatgttgattccaacagcgatggcgtttcatttaaccacacgcaatggagaaccacacatgatcgttggtaggcaggagaaagggaaaagtcttctgttcaaaacagagaatggtgtcaacatgtgcaccctcatggccatagaccttggtgaattgtgtgaagatacaatcacgtacaagtgtcctctcctcagacaaaatgaaccagaagacatagattgttggtgcaactctacgtccacatgggtaacttatgggacatgtaccactacaggagaacacagaagagaaaaaagatcagtggcgctcgttccacatgtaggtatgggactggagacacgaactgaaacatggatgtcatcagaaggggcctggaaacatgttcagagaattgaaacctggatcttgagacatccaggctttaccataatggcagcaatcctggcatacaccataggaacgacacatttccaaagggccttgattttcatcttactgacagctgtcgctccttcaatgacaatgcgctgcataggaatatcaaatagagacttcgtagaaggggtttcaggaggaagctgggttgacatagtcttagaacatggaagctgtgtgacgacgatggcaaaaaacaaaccaacattggattttgaactaataaaaacagaagccaaacaacctgccactcttaggaagtactgtgtagaagcaaagctgaccaacacaacaacagaatctcgttgcccaacacaaggggaacccagtctaaatgaagagcaggacaaaaggttcatttgcaaacactccatggtagacagaggatggggaaatggatgtggattatttggaaagggaggcattgtgacctgtgctatgtttacatgcaaaaagaacatggaaggaaaagtcgtgcagccagaaaatttggaatacaccatcgtgataacacctcactcaggagaagagcacgctgtaggtaatgacacaggaaagcatggcaaggaaatcaagataacaccacagagttccatcacagaagcagaactgacaggctatggtactgtcacgatggaatgctctccgagaacgggcctcgacttcaatgagatggtgctgctgcagatggaagacaaagcttggctggtacacaggcaatggttcctagacctgccgttaccatggctacctggagcggacacacaaggatcaaattggatacagaaagagacattggtcactttcaaaaatccccacgcgaagaaacaggatgtcgtcgtcttagggtctcaagaaggggccatgcatacggcactcacaggggccacagaaatccagatgtcatcaggaaacttactgttcacaggacatctcaagtgcaggctgagaatggacaaactacagctcaaaggaatgtcatactctatgtgcacaggaaagtttaaaattgtgaaggaaatagcagaaacgcaacatggaacaatagttatcagagtacaatatgaaggggacggttctccatgtaagatcccttttgagataatggatttggaaaaaagacacgtcttaggtcgcctgatcacagttaacccaatcgtagcagaaaaagatagcccagtcaacatagaagcagaacctccattcggagacagctacatcatcataggagtagagccgggacaattgaaactcaattggtttaagaagggaagttccatcggccaaatgtttgagacaacgatgagaggagcaaagagaatggccattctaggtgacacagcctgggattttggatccctgggaggagtgttcacatctataggaaaggctctccaccaagttttcggagcaatctatggggctgcttttagtggggtctcatggactatgaaaatcctcataggagtcatcatcacatggataggaatgaattcacgtagcacctcactgtctgtgtcgctagtattggtgggagtcgtgacactatacctgggagctatggtgcaggctgacagtggttgcgttgtgagctggaaaaacaaagaactgaaatgtggcagcgggatcttcattacagacaacgtgcacacatggacagaacaatataagttccaaccagaatccccttcaaaactagcttcagctatccaaaaagctcatgaagagggcatttgtggaatccgctcagtaacaagattggagaatctgatgtggaaacaaataacaccagaattgaatcatattctatcagaaaatgaggtaaagttgaccattatgacaggagacattaaaggaatcatgcaggcaggaaaacgatctttgcggccccagcccacagagttgaaatactcatggaaaacatggggaaaggcgaaaatgctctccacagagtctcacaatcagacctttcttattgatggccccgaaacagcagaatgccccaacacaaacagagcttggaactcgctggaagtcgaggactatggttttggagtttttaccaccaatatatggctaaagttgagagaaaaacaggatgtattttgtgactcaaaactcatgtcagcggccgttaaagacaacagagccgtccatgctgatatgggttattggatagaaagtgcactcaatgacacatggaagatggagaaagcctccttcattgaagttaaaagctgccactggccaaagtcacacactctctggagcaatggagtattagaaagtgagatgataattccgaaaaatttcgccgggccagtgtcacaacacaactacagaccaggctaccatacacaaacagcaggaccttggcacctaggcaagcttgagatggactttgatttctgcgaaggaactacagtggtggtgactgaggactgtggaaatagaggaccttctctaagaacgaccactgcctctggaaaactcataacagaatggtgctgccgatcctgcacactaccacctctaagatacagaggtgaggatggatgctggtacgggatggaaatcagaccattgaaagagaaagaggagaatttggtcaattccttggtcacagccggacatgggcagattgacaacttttcactaggagtcttgggaatggcactgttcctggaagaaatgctcaggacccgagtaggaacgaaacatgcaatactgctagttgcagtatcttttgtgacattgattactgggaacatgtcttttagagacctgggaagagtgatggttatggtgggcgctaccatgacggatgacataggtatgggagtgacttatcttgccctactagcagctttcaaagttagaccaacttttgcagctggactactcttgagaaaactgacttccaaggaattaatgatggccaccataggagtcgctctcctttcccaaagcaccataccagagaccattcttgaactgactgatgcgttagccttgggcatgatggctctcaaaatagtgaaaaatatggaaaagtaccaattggcagtgactatcatggccatttcgtgtgtcccaaatgcagtgatattgcaaaacgcatggaaggtgagttgcacaatattggcagcggtgtccgtttctccactgctcttaacatcctcacagcaaaaagcggattggataccactggcattgacgataaaaggtctcaatccaacagccatttttttaacgactctttcgagaactagcaagaaaaggagctggccactaaatgaagctatcatggcagttgggatggtgagcattttagccagttctctcctgaagaatgatattcccatgacaggtccattagtggctggagggctccttacagtatgttatgtgctcactggacgatcggccgatttggaactagagagagctgccgatgtaaaatgggaagatcaggcagaaatatcaggaagcagcccaatcctgtcaataacaatatcagaagatggcagcatgtcgataaaaaatgaagaggaagaacaaacactgaccatactcattagaacgggattgttggtgatctcaggagtctttccagtatcgataccaattacggcagcagcatggtacctgtgggaagtgaagaaacaacgggctggagtattgtgggacgtcccttcacccccaccagtaggaaaagctgaactggaagaaggagcttatagaatcaagcaaagagggattctaggatattctcagattggagctggagtttacaaagaaggaacattccatacaatgtggcacgtcacacgcggtgctgttctgatgcatagagggaagaggattgaaccatcatgggcagatgtcaagaaagacctagtgtcatatggaggaggctggaagctagaaggagaatggaaggaaggagaggaagtccaagtcctggcattagaacctggaaaaaatccaagagccgtccaaacgaaacctggaattttcaaaaccaacactggaaccataggcgccgtatctctggacttttcccctggaacgtcaggatctccaattgttgacagaaaaggaaaagttgtgggtctttacggtaatggtgttgtcacaaggagtggagcatatgtaagtgctatagcccagaccgataaaagcattgaagacaatccagagatcgaagatgacatttttcgaaagaaaagattgaccatcatggacctccatccaggagcaggaaagacaaaaagataccttccagccatagttagagaagccataaaacgtggcttgagaacattaatcctggctcccaccagagtcgtggcagctgaaatggaagaagctcttagaggacttccaataaggtaccaaaccccagccatcagagccgagcacaccgggcgggagatcgtggacttaatgtgtcatgccacatttactatgaggctgctatcaccagtcagagtgccaaattacaacctgatcatcatggacgaagcccacttcacagacccagcaagcatagcagctagaggatacatttcaactcgggtagagatgggtgaagcagctgggattttcatgacagccactcctccgggaagtagagacccatttcctcagagcaatgcaccaatcatggatgaggaaagagaaatccctgagcgttcgtggaattcaggacatgaatgggtcacggattttaaagggaagaccgtttggtttgttccaagtataaaagcaggaaatgacatcgcagcttgtcttaggaagaatggaaagaaagtgatacaactcagtagaaagacttttgactctgagtatgttaagactagagccaatgattgggattttgtggtcacaactgacatttcagaaatgggtgccaacttcaaggctgagagggttatagaccccagacgttgcatgaaaccagttatactaacagatggcgaagagcgggtgatcttggcaggacctatgccagtgacccactctagtgcagcgcaaagaagagggagaataggaagaaatccaaaaaatgaaaatgaccagtacatatacatgggggaacctctcgaaaatgacgaagactgtgcacattggaaagaagccaaaatgctcctagataacatcaacacacccgaaggaatcattcctagtatgttcgaaccagagcgtgaaaaagtggatgccattgatggtgaataccgtttgagaggagaagcaaggaaaacctttgtggacctaatgagaagaggggacttaccagtctggttagcctacaaagtggcagctgaaggcatcaactacgcagacagaaggtggtgttttgatggaattaagaataatcaaatactggaagaaaatgtggaagtggaaatctggacgaaagaaggggaaaggaaaaaattaaaacccagatggttggatgctaggatctattctgacccactagcactaaaagaattcaaggaatttgcagctgggagaaaatctttgaccctgaacctaatcacagaaatgggtaggcttccaactttcatgactcagaaggcaagaaacgcactggacaacttggctgtgctgcatacggctgaggcaggtggaaaggcgtacaatcatgctctcagtgaactgccggagaccctggagacactgcttctactgacactcctggcaacagtcacaggaggaatcttcttattcttaatgagcggaaaaggtatagggaagatgaccctgggaatgtgttgcataatcacagctagtatcctactatggtatgcacagatacaaccacactggatagcagcttcaataatactggagttttttctcatagttttgctcattccagaaccagaaaaacagagaacacctcaagacaaccaattgacctacgttgtcatagccatcctcacagtagtggccgcaacaatggcgaacgagatgggtttcctggaaaaaaccaagaaagatctcggattgggaagcattacaacccaggaatctgagagcaacatcttggacatagatctacgtcctgcatcagcatggacgctgtatgccgtggctacaacatttgtcacaccaatgttgaggcatagcattgaaaattcctcagtgaatgtctccctaacagccattgctaaccaagctacagtgctgatgggtctcgggaaaggatggccattgtcaaagatggacatcggagttcccctcctcgccattggatgctactcacaagtcaaccctataactctcacagcagctcttctcttattggtagcacattatgccattatagggccaggacttcaagcaaaagcaaccagagaagctcagaagagagcagcagcaggcatcatgaaaaacccaacagtcgatggaataacagtgattgacctagaaccaataccctatgatccaaaatttgaaaagcagttaggacaagtaatgctcctaatcctctgcgtgactcaagtattaatgatgaggactacatgggctttatgcgaggctctaaccttagcgaccgggcccatctccacattgtgggaaggaaatccagggaggttttggaacactactattgcagtgtcaatggctaacatctttagggggagctacttggccggagctggacttctcttttccatcatgaagaacacaacaaacacaagaagaggaactggcaacataggagagacacttggagaaaaatggaaaagccgattaaacgcactgggaaaaagtgaatttcagatctacaagaaaagtggaatccaggaagtggatagaaccctggcaaaagaaggcatcaaaagaggagaaacggaccaccatgctgtgtcgcgaggttcagcaaaactgagatggttcgtcgagagaaatatggtcacaccggaagggaaggtggtggatctcggttgcggcagagggggctggtcatactattgtgggggactaaagaatgtaagagaagtcaaaggcctaacaaaaggaggaccaggacacgaagaacctatccccatgtcaacatatgggtggaatctagtgcgtctgcaaagtggagttgacgttttcttcaccccgccagaaaagtgtgatacattgttgtgtgacataggggagtcgtcaccaaatcccacgatagaagcaggacgaacactcagagtcctcaacttagtggaaaattggttgaacaataacacccaattttgcataaaggtcctcaacccatatatgccctcagtaatagaaaaaatggaaacactacaaaggaaatatggaggagccctagtgaggaatccactctcacgaaactccacgcatgagatgtattgggtatctaatgccaccgggaacatagtgtcatcagtgaacatgatttcaaggatgttgattaacagatttacaatgaaacacaagaaagccacctacgagccagatgttgacctaggaagtggaactcgcaacattggaattgaaagtgaggtaccaaatctagacataataggaaagagaatagagaaaataaagcaagagcatgaaacatcatggcactatgaccaagaccacccatacaaaacgtgggcttaccatggcagctatgaaacaaaacaaactggatcagcatcatctatggtgaacggagtggtcagactgctgacaaaaccttgggacgtcgtccctatggtgacacagatggcaatgacagacacgactccatttggacaacagcgcgttttcaaagagaaagtggacacgagaacccaagaaccgaaggaaggcacaaagaaactgatgaaaattacggcagagtggctttggaaagaactaggaaagaaaaagatacctaggatgtgtaccagagaagaattcacaagaaaggtgagaagcaatgcagccttgggggccatattcactgatgagaacaaatggaaatcggcacgtgaggctgttgaagatggtaggttttgggagctggttgacagggaaagaaatctccatcttgagggaaagtgtgaaacatgtgtgtacaacatgatgggaaaaagagagaagaaactaggggagttcggcaaggcaaaaggtagcagagccatatggtacatgtggcttggagcacgcttcttagagtttgaagccctaggattcctgaatgaagatcactggttctccagagggaactccctgagtggagtggaaggagaagggctgcacaggctaggctacattttaagagacgtgagcaagaaggaagggggagcaatgtacgccgatgatacagcaggatgggacacaagaatcacactagaagacttaaaaaatgaagaaatgataacaaaccacatgaaaggagaacacaagaaactagccgaggccatattcaaattaacgtaccaaaacaaagtggtgcgtgtgcaaagaccaacaccaagaggcacagtaatggatatcatatcgagaagagaccaaagaggcagtgggcaagtcggcacctatggccttaatactttcaccaatatggaagcccaattgatcagacagatggagggagaaggaatcttcaaaagcattcagcacctgacagtcacagaagaaatcgctgtacagaactggctagcaagagtggggcgtgaaaggctaacaagaatggccatcagtggagatgattgtgttgtaaaacctatagatgacagatttgcaaatgctttaacagctctaaatgacatgggaaaagttaggaaagatatacaacaatgggaaccttcaagaggatggaacgattggacacaagtgcctttctgttcacaccattttcatgagttagtcatgaaagatggtcgcgtgctcgtagtcccatgcagaaaccaagatgaactgattggtagagcccgaatttcccagggagccgggtggtctctgaaggagacggcctgtttggggaagtcttacgcccaaatgtggaccctgatgtacttccacagacgtgacctcagactggcggcaaatgccatttgctcggcagttccgtcacattgggttccaacaagtcgaacaacctggtccatacacgctaagcatgaatggatgacgacggaagacatgctggcagtctggaacagggtgtggatccaagaaaacccgtggatggaagacaaaactccagtggaatcatgggaagaagtcccatacttggggaaaagagaagaccaatggtgtggctcattgattgggttaacaagcagggctacttgggcaaagaacatccaaacagcaataaaccaagtcagatccctcataggcaatgagggatatacagactacatgccatccatgaagagattcagaagggaagaggaagaagcaggtgtcctgtggtag
